US012060411B2

(12) United States Patent
Nussenzweig et al.

(10) Patent No.: US 12,060,411 B2
(45) Date of Patent: Aug. 13, 2024

(54) NEUTRALIZING ANTI-SARS-CoV-2 ANTIBODIES

(71) Applicant: The Rockefeller University, New York, NY (US)

(72) Inventors: Michel Nussenzweig, New York, NY (US); Zijun Wang, New York, NY (US)

(73) Assignee: The Rockefeller University, New York, NY (US)

( * ) Notice: Subject to any disclaimer, the term of this patent is extended or adjusted under 35 U.S.C. 154(b) by 0 days.

(21) Appl. No.: 17/575,246

(22) Filed: Jan. 13, 2022

(65) Prior Publication Data

US 2022/0227844 A1    Jul. 21, 2022

Related U.S. Application Data

(60) Provisional application No. 63/199,676, filed on Jan. 15, 2021.

(51) Int. Cl.

| C07K 16/10 | (2006.01) |
| A61K 39/42 | (2006.01) |
| A61K 45/06 | (2006.01) |
| G01N 33/569 | (2006.01) |

(52) U.S. Cl.
CPC .............. *C07K 16/10* (2013.01); *A61K 39/42* (2013.01); *A61K 45/06* (2013.01); *G01N 33/56983* (2013.01); *C07K 2317/31* (2013.01); *C07K 2317/35* (2013.01); *C07K 2317/76* (2013.01); *G01N 2333/165* (2013.01); *G01N 2800/26* (2013.01); *G01N 2800/52* (2013.01)

(58) Field of Classification Search
CPC .... C07K 16/10; C07K 2317/31; A61K 39/42; A61K 45/06
See application file for complete search history.

(56) References Cited

U.S. PATENT DOCUMENTS

| 11,053,304 | B1 * | 7/2021 | Glanville | ................. | A61P 31/14 |
| 11,634,477 | B2 * | 4/2023 | Nussenzweig | ......... | C07K 16/10 |
| | | | | | 424/133.1 |
| 2006/0121580 | A1 * | 6/2006 | Ter Meulen | ........... | C07K 16/10 |
| | | | | | 435/6.16 |
| 2021/0332110 | A1 | 10/2021 | Nussenzweig et al. | | |
| 2022/0195015 | A1 * | 6/2022 | Nussenzweig | ......... | A61K 39/42 |

OTHER PUBLICATIONS

Edwards et al. The Remarkable Flexibility of the Human Antibody Repertoire; Isolation of Over One Thousand Different Antibodies to a Single Protein, BLyS, J. Mol. Biol. 2003, 334:103-118. (Year: 2003).*
Lloyd et al. Modelling the human immune response: performance of a 1011 human antibody repertoire against a broad panel of therapeutically relevant antigens, Protein Engineering Design & Selection. 2009, 22;3: 159-168) (Year: 2009).*
Goel et al. Plasticity within the Antigen-Combining Site May Manifest as Molecular Mimicry in the Humoral Immune Response, The Journal of Immunology. 2004, 173:7358-7367 (Year: 2004).*
Kanyavuz et al. Breaking the law: unconventional strategies for antibody diversification, Nature Review Immunology. 2019, 19:355-368 (Year: 2019).*
Janeway et al., Immunology Third Edition, Garland Publishing Inc. 1997, Chapter 3, Structure of the Antibody Molecule and Immunoglobulin Genes, pp. 3:1-3:11, see entire selection (Year: 1997).*
Rudikoff et al., Single amino acid substitution altering antigen-binding specificity, PNAS, USA, 1982, 79: 1979-1983 (Year: 1982).*
Ter Meulen et al., Human Monoclonal Antibody Combination against SARS Coronavirus: Synergy and Coverage of Escape Mutants, PLoS Medicine, vol. 3, Issue 7, e237, Publication Date: Jul. 4, 2006 (Year: 2006).*
Tian et al., Potent binding of 2019 novel coronavirus spike protein by a SARS coronavirus-specific human monoclonal antibody, Emerging Microbes & Infections, 9:382-385, Published Date: Feb. 17, 2020 (Year: 2020).*
Koivunen et al., Principles of Immunochemical Techniques Used in Clinical Laboratories, Labmedicine, vol. 37, No. 8, pp. 490-497, Publication Date: Aug. 2006 (Year: 2006).*
Barnes Christopher O. et al: "SARS-CoV-2 neutralizing antibody structures inform therapeutic strategies", Nautre, vol. 588, No. 7839, Oct. 12, 2020 (Oct. 12, 2020), pp. 682-687.
Weisblum Yiska et al: "Escape from neutralizing antibodies by SARS-CoV-2 spike protein variants", ELIFE, vol. 9, Oct. 28, 2020 (Oct. 28, 2020), 31 pages.
Wang Bei et al: "Bivalent binding of a fully human IgG to the SARS-CoV-2 spike proteins reveals mechanisms of potent neutralization", bioRxiv, Jul. 15, 2020 (Jul. 15, 2020), 24 pages.
Robbiani Davide F et al: "Convergent antibody responses to SARS-CoV-2 in convalescent individuals", Nature, Nature Publishing Group UK, London, vol. 584, No. 7821, Jun. 18, 2020 (Jun. 18, 2020), pp. 437-442.
Wang Zijun et al: "mRNA vaccine-elicited antibodies to SARS-CoV-2 and circulating variants", Nature, Nature Publishing Group UK, London, vol. 592, No. 7855, Feb. 10, 2021 (Feb. 10, 2021), pp. 616-622.
Gaebler Christian et al: "Evolution of antibody immunity to SARS-CoV-2", Nature, vol. 591, No. 7851, Jan. 18, 2021 (Jan. 18, 2021), pp. 639-644.
Wang Zijun et al: "Naturally enhanced neutralizing breadth against SARS-CoV-2 one year after infection", Nature, Nature Publishing Group UK, London, vol. 595, No. 7867, Jun. 14, 2021 (Jun. 14, 2021), pp. 426-431.
Cho Alice et al: "Anti-SARS-CoV-2 receptor-binding domain antibody evolution after mRNA vaccination", Nature, Nature Publishing Group UK, London, vol. 600, No. 7889, Oct. 7, 2021 (Oct. 7, 2021), pp. 517-522.

(Continued)

*Primary Examiner* — Peter J Reddig
*Assistant Examiner* — Cheng Lu
(74) *Attorney, Agent, or Firm* — Fox Rothschild LLP

(57) ABSTRACT

This disclosure provides novel neutralizing anti-SARS-CoV-2 antibodies or antigen-binding fragments thereof. The disclosed anti-SARS-CoV-2 antibodies constitute a novel therapeutic strategy in protection from SARS-CoV-2 infections.

27 Claims, 13 Drawing Sheets

Specification includes a Sequence Listing.

(56) References Cited

OTHER PUBLICATIONS

Muecksch Frauke et al: "Affinity maturation of SARS-CoV-2 neutralizing antibodies confers potency, breadth, and resilience to viral escape mutations", Immunity, Cell Press, Amsterdam, NL, vol. 54, No. 8, Jul. 30, 2021 (Jul. 30, 2021), p. 1853.
De Gasparo Raoul et al: "Bispecific IgG neutralizes SARS-CoV-2 variants and prevents escape in mice", Nature, Nature Publishing Group UK, London, vol. 593, No. 7859, Mar. 25, 2021 (Mar. 25, 2021), pp. 424-428.
Invitation to Pay Additional Fees and, Where Applicable, Protest Fee (partial search report) mailed Apr. 19, 2022 in International Patent Application No. PCT/US2022/012299, 17 pages.

\* cited by examiner

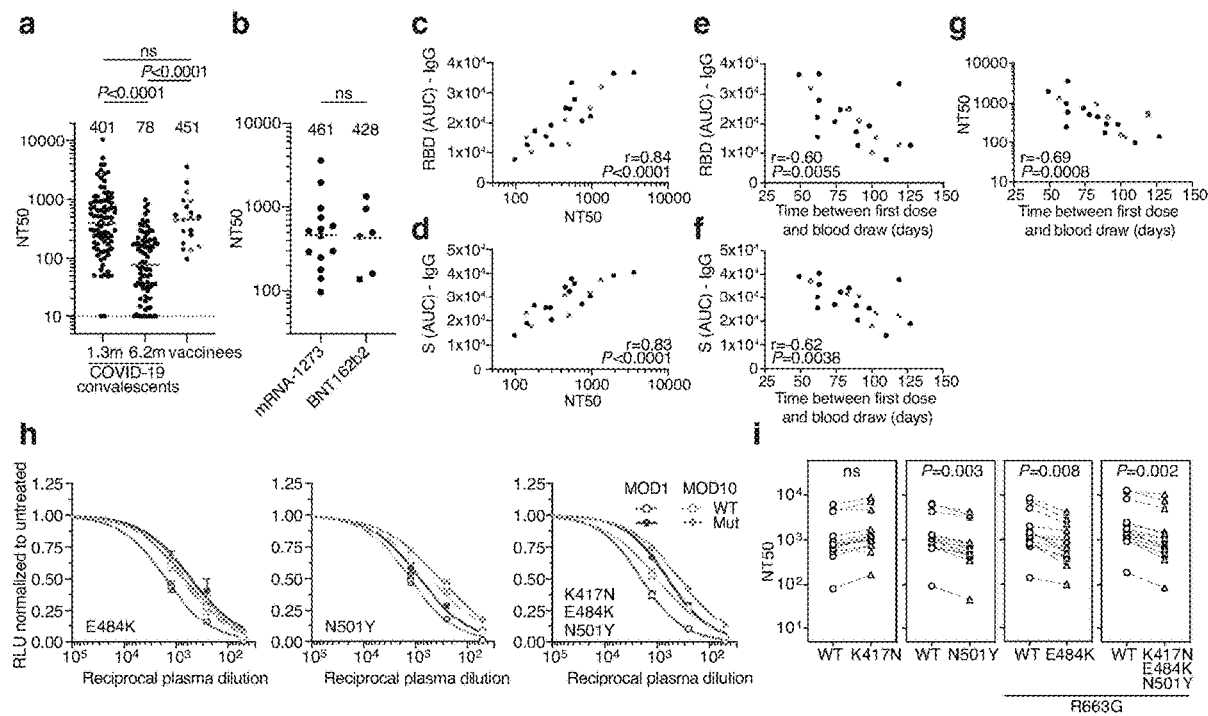
Figs. 1a, 1b, 1c, 1d, 1e, 1f, 1g, 1h, and 1i

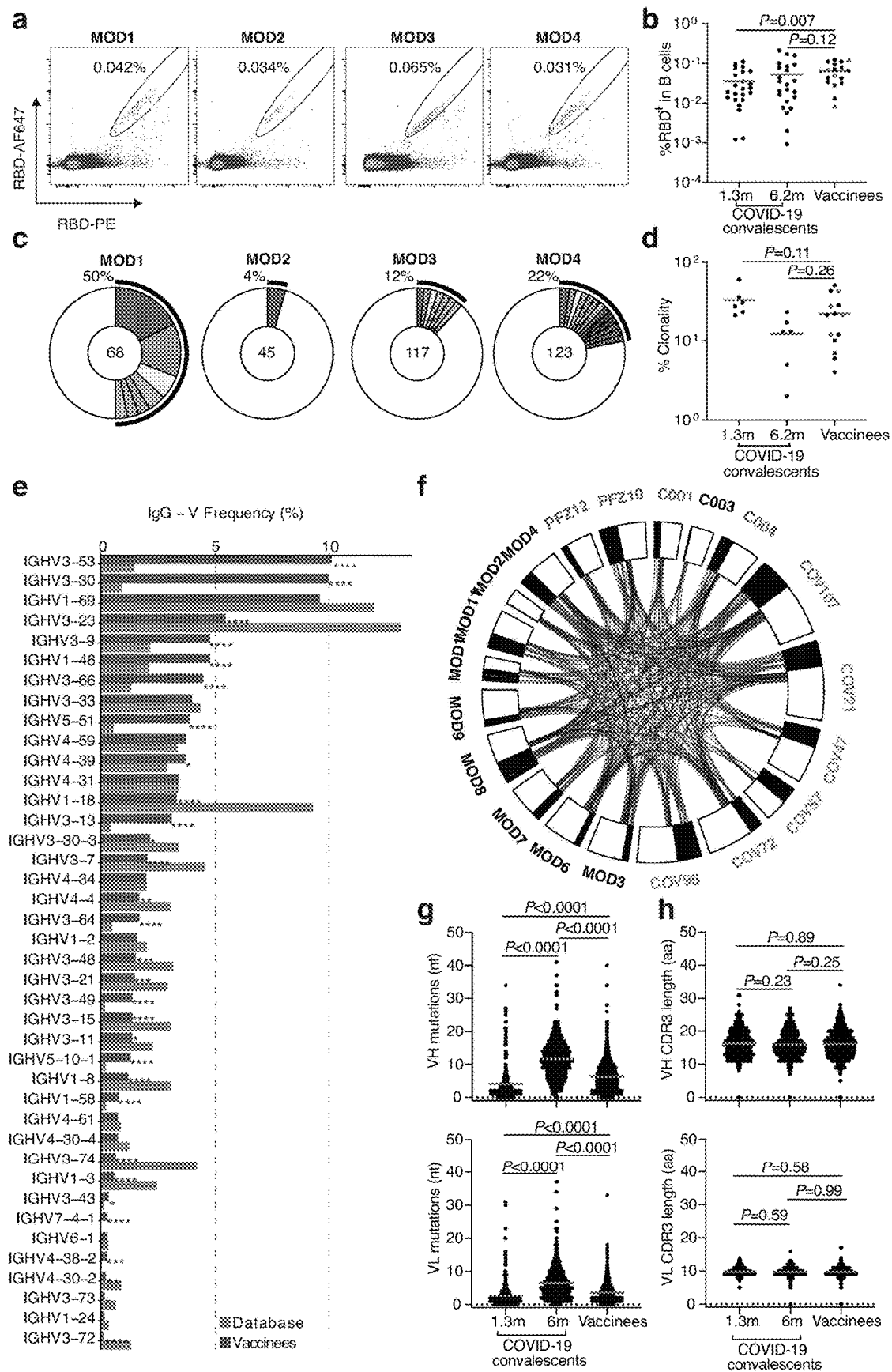
Figs. 2a, 2b, 2c, 2d, 2e, 2f, 2g, and 2h

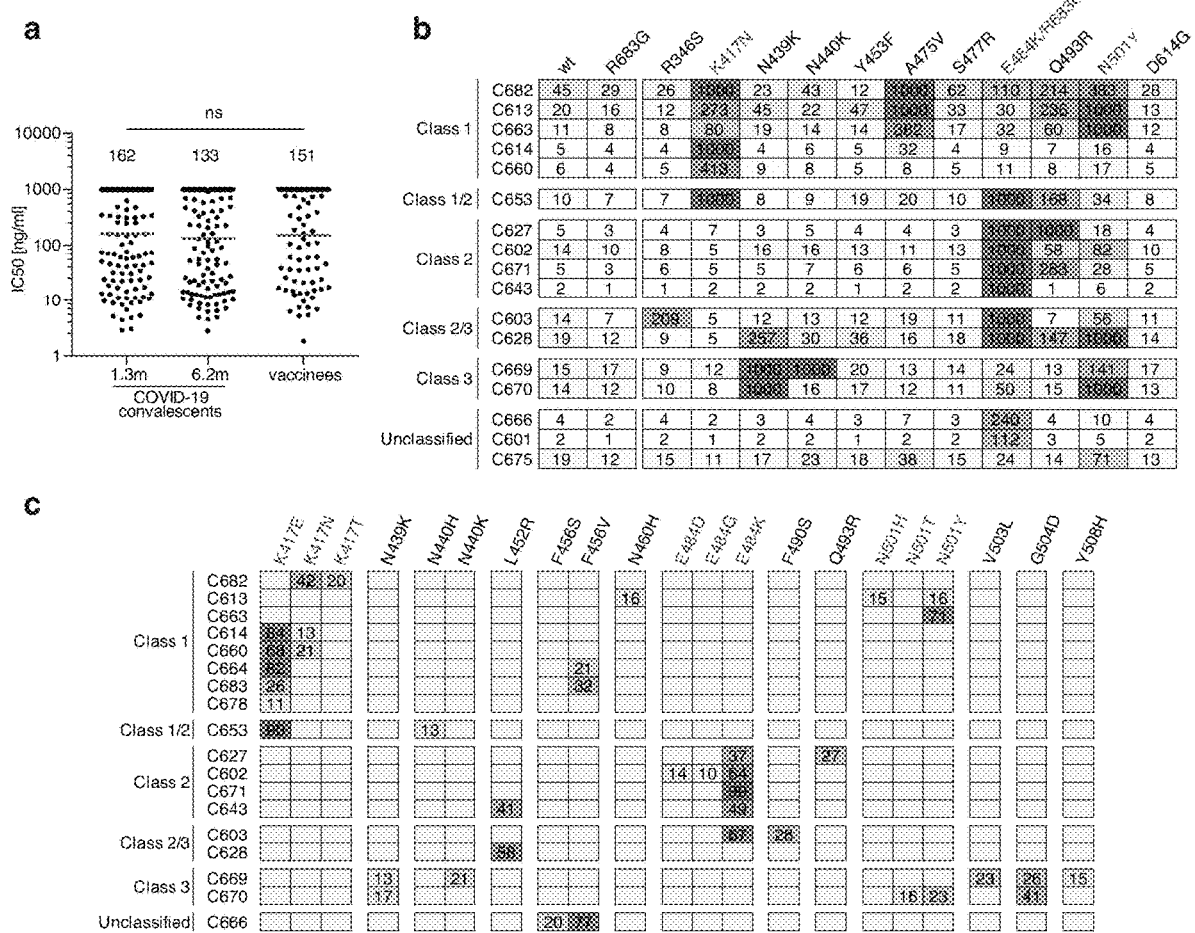
Figs. 3a, 3b, and 3c

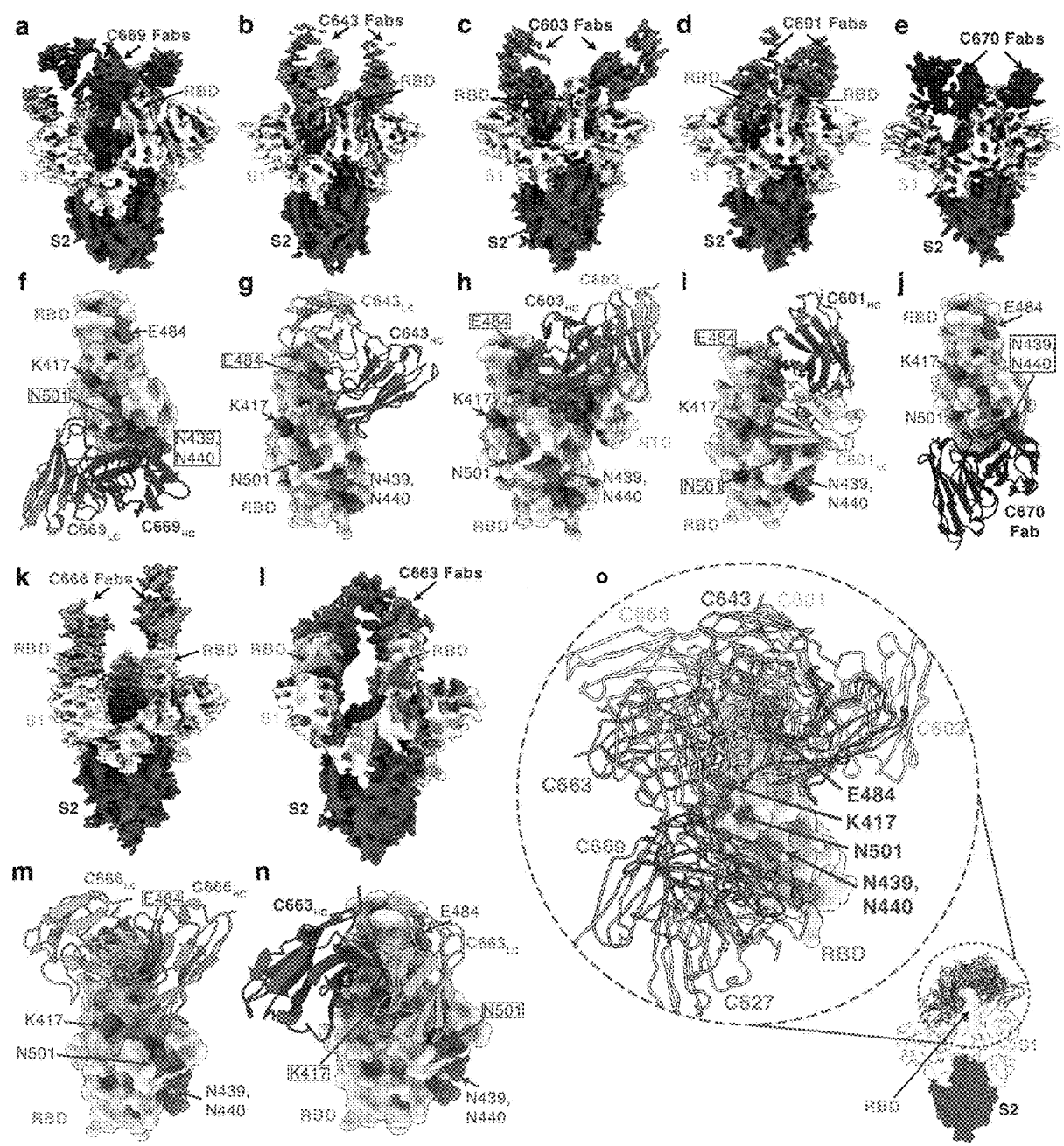
Figs. 4a, 4b, 4c, 4d, 4e, 4f, 4g, 4h, 4i, 4j, 4k, 4l, 4m, 4n, and 4o

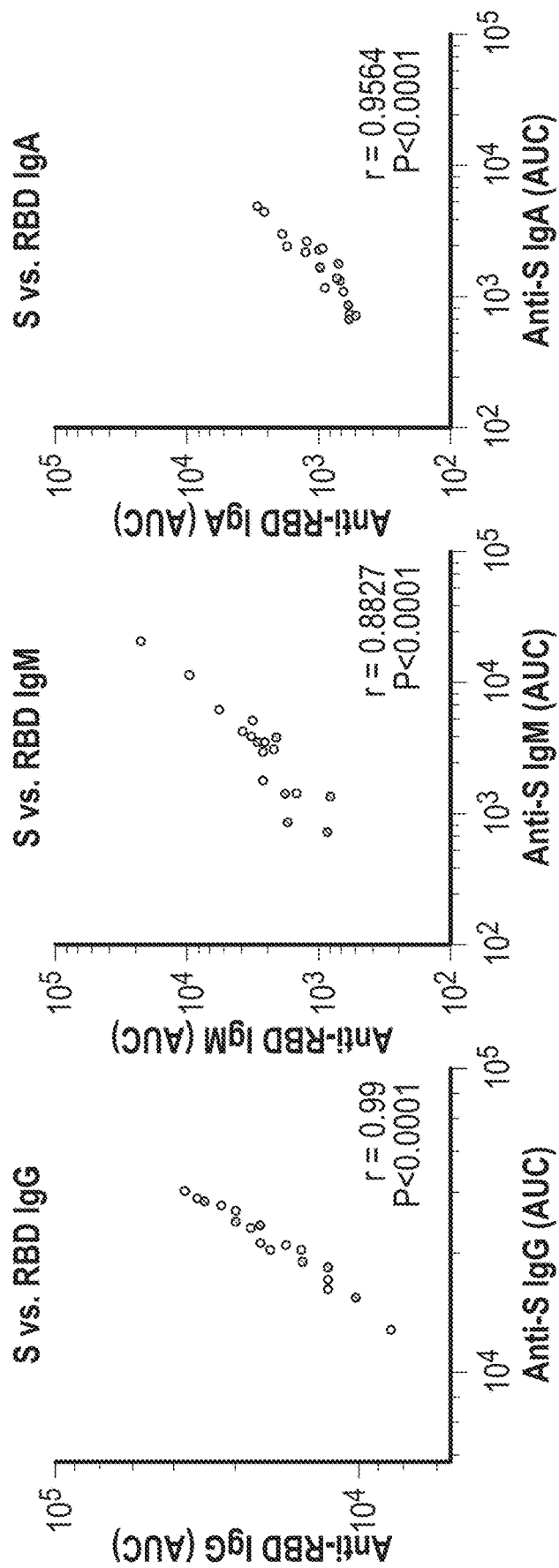

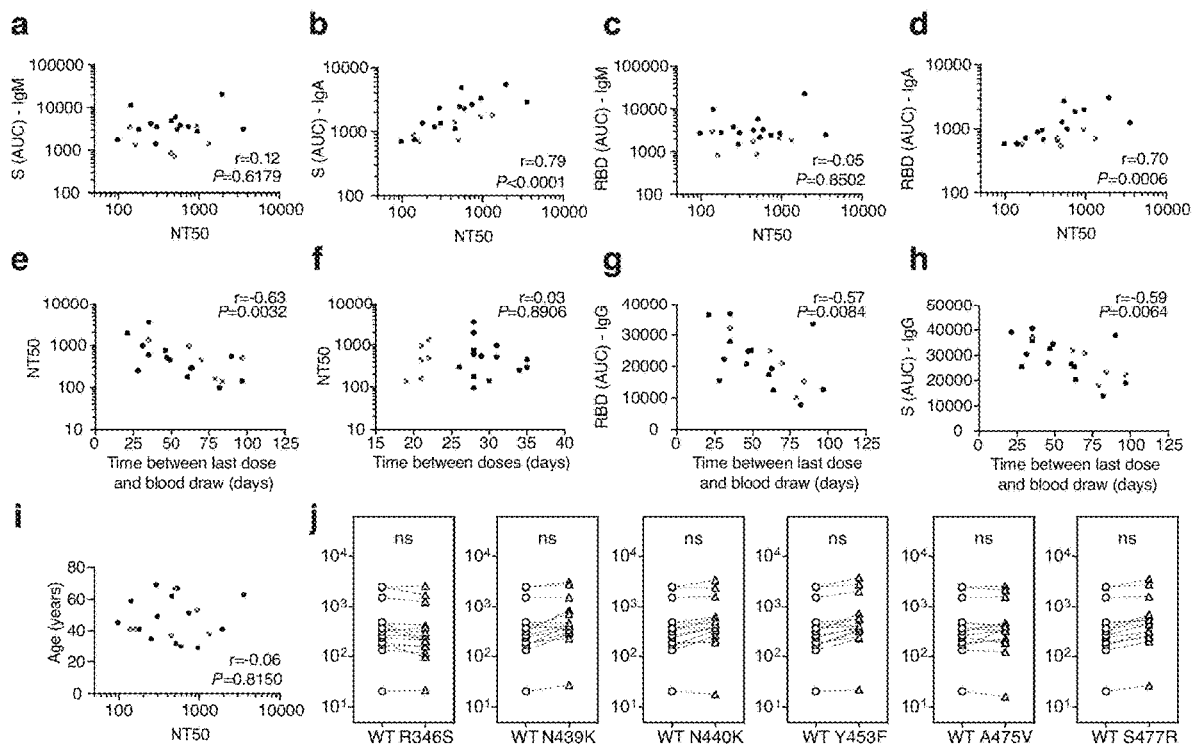
Figs. 6a, 6b, 6c, 6d, 6e, 6f, 6g, 6h, 6i, and 6j

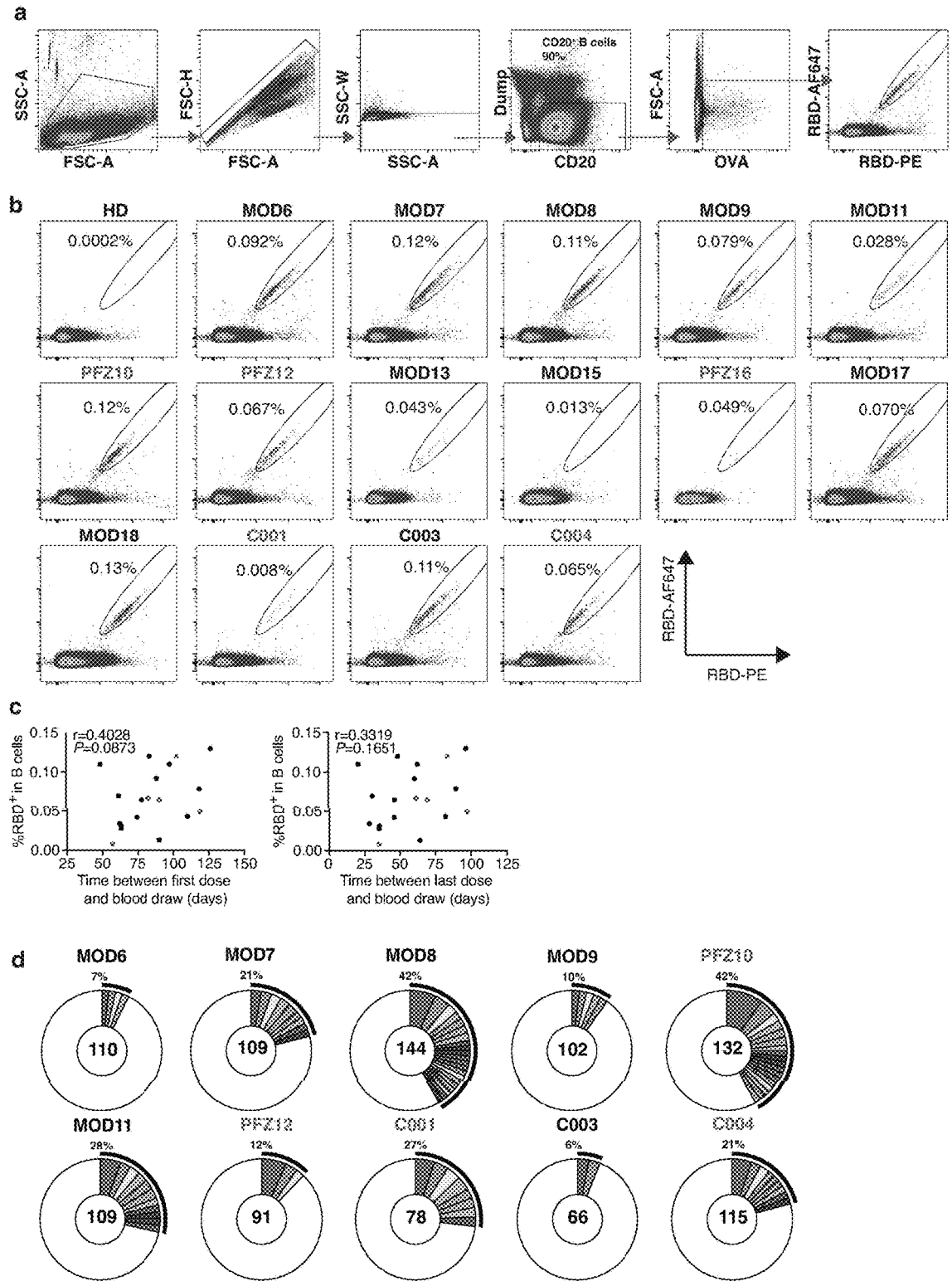
Figs. 7a, 7b, 7c, and 7d

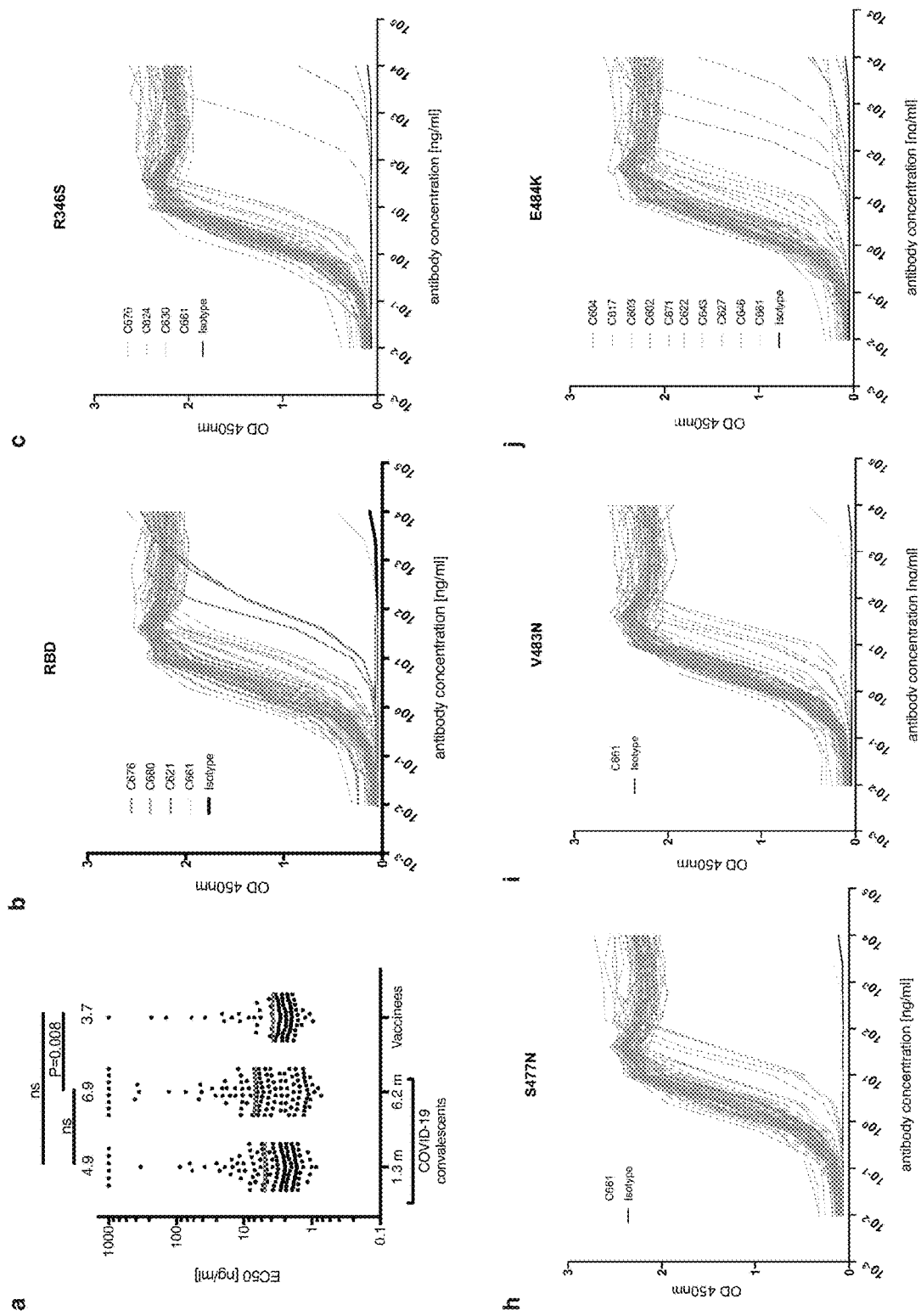
Figs. 10a, 10b, 10c, 10h, 10i, and 10j

NEUTRALIZING ANTI-SARS-CoV-2 ANTIBODIES

CROSS-REFERENCE TO RELATED APPLICATIONS

This application claims priority under 35 U.S.C. § 119(e) to U.S. Provisional Patent Application No. 63/199,676, filed Jan. 15, 2021. The foregoing application is incorporated by reference herein in its entirety.

STATEMENT REGARDING FEDERALLY FUNDED RESEARCH

This invention was made with government support under grant nos. P01-AI138398-S1 and 2U19AI111825 awarded by the National Institutes of Health. The government has certain rights in the invention.

REFERENCE TO SEQUENCE LISTING SUBMITTED ELECTRONICALLY

This application contains a sequence listing, which is submitted electronically via EFS-Web as an ASCII formatted sequence listing with a file name "Seq listing 070413.20672_ST25" and a creation date of Jan. 12, 2022, and having a size of 3,820 kb. The sequence listing submitted via EFS-Web is part of the specification and is herein incorporated by reference in its entirety.

FIELD OF THE INVENTION

The present invention relates to antibodies directed to epitopes of SARS-CoV-2 Coronavirus 2 ("SARS-CoV-2"). The present invention further relates to the preparation and use of neutralizing antibodies directed to the SARS-CoV-2 spike (S) glycoproteins for the prevention and treatment of SARS-CoV-2 infection.

BACKGROUND

SARS-CoV-2 is the virus that causes coronavirus disease 2019 (COVID-19). It contains four structural proteins, including spike (S), envelope (E), membrane (M), and nucleocapsid (N) proteins. Among them, S protein plays the most important role in viral attachment, fusion, and entry, and it serves as a target for development of antibodies, entry inhibitors, and vaccines. The S protein mediates viral entry into host cells by first binding to a host receptor through the receptor-binding domain (RBD) in the S1 subunit and then fusing the viral and host membranes through the S2 subunit. SARS-CoV and MERS-COV RBDs recognize different receptors. SARS-CoV recognizes angiotensin-converting enzyme 2 (ACE2) as its receptor, whereas MERS-COV recognizes dipeptidyl peptidase 4 (DPP4) as its receptor. Similar to SARS-CoV, SARS-CoV-2 also recognizes ACE2 as its host receptor binding to viral S protein. SARS-CoV-2 has infected 45 million individuals and is responsible for over 1 million deaths to date. There is a pressing need for agents for treating or preventing SARS-CoV-2 infection.

SUMMARY

This disclosure addresses the need mentioned above in a number of aspects by providing neutralizing anti-SARS-CoV-2 antibodies or antigen-binding fragments thereof.

In one aspect, this disclosure provides an isolated anti-SARS-CoV-2 antibody or antigen-binding fragment thereof that binds specifically to a SARS-CoV-2 antigen. In some embodiments, the SARS-CoV-2 antigen comprises a Spike (S) polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is capable of neutralizing a plurality of SARS-CoV-2 strains.

In some embodiments, the antibody or antigen-binding fragment thereof comprises: three heavy chain complementarity determining regions (HCDRs) (HCDR1, HCDR2, and HCDR3) of a heavy chain variable region having the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, or 167; and three light chain CDRs (LCDR1, LCDR2, and LCDR3) of a light chain variable region having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, or 168.

In some embodiments, the antibody or antigen-binding fragment thereof comprises: (i) a heavy chain variable region having an amino acid sequence with at least 75% identity to one selected from those in Table 2 or 4; and/or (ii) a light chain variable region having an amino acid sequence with at least 75% identity to one selected from those in Table 2 or 4.

In some embodiments, the antibody or antigen-binding fragment thereof comprises: (i) a heavy chain variable region having the amino acid sequence of one selected from those in Table 2 or 4; and/or (ii) a light chain variable region having the amino acid sequence of one selected from those in Table 2 or 4.

In some embodiments, the antibody or antigen-binding fragment thereof comprises a heavy chain variable region and a light chain variable region that comprise the amino acid sequence pair selected from those in Table 2 or 4.

In some embodiments, the antibody or antigen-binding fragment thereof comprises: a heavy chain variable region having an amino acid sequence with at least 75% identity to the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, or 167; or having the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, or 167; and a light chain variable region having an amino acid sequence with at least 75% identity to the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, or 168; or having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, or 168.

In some embodiments, the antibody or antigen-binding fragment thereof comprises a heavy chain variable region and a light chain variable region comprise the respective amino acid sequences of SEQ ID NOs: 1-2, 3-4, 5-6, 7-8, 9-10, 11-12, 13-14, 15-16, 17-18, 19-20, 21-22, 23-24, 25-26, 27-28, 29-30, 31-32, 33-34, 35-36, 37-38, 39-40, 41-42, 43-44, 45-46, 47-48, 49-50, 51-52, 53-54, 55-56, 57-58, 59-60, 61-62, 63-64, 65-66, 67-68, 69-70, 71-72, 73-74, 75-76, 77-78, 79-80, 81-82, 83-84, 85-86, 87-88, 89-90, 91-92, 93-94, 95-96, 97-98, 99-100, 101-102, 103-104, 105-106, 107-108, 109-110, 111-112, 113-114, 115-116, 117-118, 119-120, 121-122, 123-124, 125-126, 127-128, 129-130, 131-132, 133-134, 135-136, 137-138, 139-140, 141-142, 143-144, 145-146, 147-148, 149-150, 151-152, 153-154, 155-156, 157-158, 159-160, 161-162, 163-164, 165-166, or 167-168.

In some embodiments, the antibody or antigen-binding fragment thereof is a multivalent antibody that comprises (a) a first target binding site that specifically binds to an epitope within the S polypeptide, and (b) a second target binding site that binds to a different epitope on the S polypeptide or a different molecule. In some embodiments, the multivalent antibody is a bivalent or bispecific antibody.

In some embodiments, the antibody or the antigen-binding fragment thereof further comprises a variant Fc constant region. In some embodiments, the antibody is a monoclonal antibody. In some embodiments, the antibody is a chimeric antibody, a humanized antibody, or a humanized monoclonal antibody. In some embodiments, the antibody is a single-chain antibody, Fab or Fab2 fragment.

In some embodiments, the antibody or antigen-binding fragment thereof is detectably labeled or conjugated to a toxin, a therapeutic agent, a polymer, a receptor, an enzyme, or a receptor ligand. In some embodiments, the polymer is polyethylene glycol (PEG).

For example, an antibody of the invention may be coupled to a toxin. Such antibodies may be used to treat animals, including humans, that are infected with the virus that is etiologically linked to SARS-CoV-2. For example, an antibody that binds to the spike protein of the coronavirus that is etiologically linked to SARS-CoV-2 may be coupled to a tetanus toxin and administered to an animal suffering from infection by the aforementioned virus. The toxin-coupled antibody is thought to bind to a portion of a spike protein presented on an infected cell, and then kill the infected cell.

An antibody of the invention may be coupled to a detectable tag. Such antibodies may be used within diagnostic assays to determine if an animal, such as a human, is infected with SARS-CoV-2. Examples of detectable tags include fluorescent proteins (i.e., green fluorescent protein, red fluorescent protein, yellow fluorescent protein), fluorescent markers (i.e., fluorescein isothiocyanate, rhodamine, texas red), radiolabels (i.e., 3H, 32P, 125I), enzymes (i.e., β-galactosidase, horseradish peroxidase, β-glucuronidase, alkaline phosphatase), or an affinity tag (i.e., avidin, biotin, streptavidin).

In another aspect, this disclosure provides a pharmaceutical composition comprising: the antibody or antigen-binding fragment thereof of any one of the preceding claims and optionally a pharmaceutically acceptable carrier or excipient.

In some embodiments, the pharmaceutical comprises two or more of the antibody or antigen-binding fragment thereof described above, such as any combinations of the antibody or antigen-binding fragment thereof comprising a heavy chain and a light chain that comprise the respective amino acid sequences of one selected from those in Table 2 or 4.

In some embodiments, the two or more of the antibody or antigen-binding fragment thereof comprise: (1) a first antibody set comprising: (i) a first antibody or antigen-binding fragment thereof comprising a heavy chain variable region and a light chain variable region comprising the respective amino acid sequences of a first antibody selected from those in Table 2 or 4; and (ii) a second antibody or antigen-binding fragment thereof comprising a heavy chain variable region and a light chain variable region comprising the respective amino acid sequences of a second antibody selected from those in Table 2 or 4; or (2) a second antibody set comprising: (a) a third antibody or antigen-binding fragment thereof comprising a heavy chain variable region and a light chain variable region comprising the respective amino acid sequences of antibody selected from those in Table 2 or 4; and (b) a fourth antibody or antigen-binding fragment thereof comprising a heavy chain variable region and a light chain variable region comprising the respective amino acid sequences of an antibody selected from those in Table 2 or 4, wherein the third antibody is different from the fourth antibody.

In some embodiments, the pharmaceutical composition further comprises a second therapeutic agent. In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine, or an interferon. In some embodiments, the interferon is an interferon-α or an interferon-β.

Also within the scope of this disclosure is use of the pharmaceutical composition, as described above, in the preparation of a medicament for the diagnosis, prophylaxis, treatment, or combination thereof of a condition resulting from a SARS-CoV-2.

In another aspect, this disclosure also provides (i) a nucleic acid molecule encoding a polypeptide chain of the antibody or antigen-binding fragment thereof described above; (ii) a vector comprising the nucleic acid molecule as described; and (iii) a cultured host cell comprising the vector as described.

Also provided is a method for producing a polypeptide, comprising: (a) obtaining the cultured host cell as described; (b) culturing the cultured host cell in a medium under conditions permitting expression of a polypeptide encoded by the vector and assembling of an antibody or fragment thereof; and (c) purifying the antibody or fragment from the cultured cell or the medium of the cell.

In another aspect, this disclosure provides a kit comprising a pharmaceutically acceptable dose unit of the antibody or antigen-binding fragment thereof or the pharmaceutical composition as described above. Also within the scope of this disclosure is a kit for the diagnosis, prognosis, or monitoring of the treatment of SARS-CoV-2 in a subject, comprising: the antibody or antigen-binding fragment thereof as described; and a least one detection reagent that binds specifically to the antibody or antigen-binding fragment thereof.

In yet another aspect, this disclosure further provides a method of neutralizing SARS-CoV-2 in a subject. The method comprises administering to a subject in need thereof a therapeutically effective amount of the antibody or antigen-binding fragment thereof or a therapeutically effective amount of the pharmaceutical composition, as described herein.

In yet another aspect, this disclosure additionally provides a method of preventing or treating a SARS-CoV-2 infection. The method comprises administering to a subject in need thereof a therapeutically effective amount of the antibody or antigen-binding fragment thereof or a therapeutically effective amount of the pharmaceutical composition, as described herein.

In some embodiments, the method of neutralizing SARS-CoV-2 in a subject comprises administering to a subject in need thereof a therapeutically effective amount of a first antibody or antigen-binding fragment thereof and a second antibody or antigen-binding fragment thereof of the antibody or antigen-binding fragment, as described above, wherein the first antibody or antigen-binding fragment thereof and the second antibody or antigen binding fragment thereof exhibit synergistic activity or a therapeutically effective amount of the pharmaceutical composition described above.

In some embodiments, the method of preventing or treating a SARS-CoV-2 infection, comprising administering to a subject in need thereof a therapeutically effective amount of a first antibody or antigen-binding fragment thereof and a second antibody or antigen-binding fragment thereof of the antibody or antigen-binding fragment, as described above, wherein the first antibody or antigen-binding fragment thereof and the second antibody or antigen binding fragment thereof exhibit synergistic activity or a therapeutically effective amount of the pharmaceutical composition described above. In some embodiments, the first antibody or antigen-binding fragment thereof is administered before, after, or concurrently with the second antibody or antigen-binding fragment thereof.

In some embodiments, the first antibody or antigen-binding fragment thereof and the second antibody or antigen-binding fragment thereof can be any combinations of the antibody or antigen-binding fragment thereof comprising a heavy chain and a light chain that comprise the respective amino acid sequences of an antibody selected from those in Table 2 or 4.

In some embodiments, the second therapeutic agent comprises an anti-inflammatory drug or an antiviral compound. In some embodiments, the antiviral compound comprises a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine, or an interferon. In some embodiments, the interferon is an interferon-$\alpha$ or an interferon-$\beta$.

In some embodiments, the antibody or antigen-binding fragment thereof is administered before, after, or concurrently with the second therapeutic agent or therapy. In some embodiments, the antibody or antigen-binding fragment thereof is administered to the subject intravenously, subcutaneously, or intraperitoneally. In some embodiments, the antibody or antigen-binding fragment thereof is administered prophylactically or therapeutically.

In another aspect, this disclosure further provides a method for detecting the presence of SARS COV-2 in a sample comprising the steps of: (i) contacting a sample with the antibody or antigen-binding fragment thereof described above; and (ii) determining binding of the antibody or antigen-binding fragment to one or more SARS COV-2 antigens, wherein binding of the antibody to the one or more SARS COV-2 antigens is indicative of the presence of SARS COV-2 in the sample. In some embodiments, the sample is a blood sample.

In some embodiments, the SARS-CoV-2 antigen comprises a S polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is conjugated to a label. In some embodiments, the step of detecting comprises contacting a secondary antibody with the antibody or antigen-binding fragment thereof and wherein the secondary antibody comprises a label. In some embodiments, the label includes a fluorescent label, a chemiluminescent label, a radiolabel, and an enzyme.

In some embodiments, the step of detecting comprises detecting fluorescence or chemiluminescence. In some embodiments, the step of detecting comprises a competitive binding assay or ELISA.

In some embodiments, the method further comprises binding the sample to a solid support. In some embodiments, the solid support includes microparticles, microbeads, magnetic beads, and an affinity purification column.

The foregoing summary is not intended to define every aspect of the disclosure, and additional aspects are described in other sections, such as the following detailed description. The entire document is intended to be related as a unified disclosure, and it should be understood that all combinations of features described herein are contemplated, even if the combination of features are not found together in the same sentence, or paragraph, or section of this document. Other features and advantages of the invention will become apparent from the following detailed description. It should be understood, however, that the detailed description and the specific examples, while indicating specific embodiments of the disclosure, are given by way of illustration only, because various changes and modifications within the spirit and scope of the disclosure will become apparent to those skilled in the art from this detailed description.

BRIEF DESCRIPTION OF THE DRAWINGS

FIGS. 1a, 1b, 1c, 1d, 1e, 1f, 1g, 1h, and 1i are a set of diagrams showing plasma neutralizing activity of the neutralizing antibodies. FIG. 1a shows SARS-CoV-2 pseudovirus neutralization assay. $NT_{50}$ values for COVID-19 convalescent plasma were measured at 1.3 months and 6.2 months as well as plasma from mRNA-vaccinees. $NT_{50}$ values lower than 10 were plotted at 10. Mean of 2 independent experiments. Indicated values represent geometric mean $NT_{50}$ values. Statistical significance was determined using a two-tailed Mann-Whitney U-test. FIG. 1b shows $NT_{50}$ values for Moderna and Pfizer/BioNTech vaccine recipients. Bars and indicated values represent geometric mean $NT_{50}$ values. Statistical significance was determined using a two-tailed Mann-Whitney U-test. FIG. 1c shows anti-RBD IgG AUC (Y axis) plotted against $NT_{50}$ (X axis) r=0.84, p<0.0001. FIG. 1d shows anti-S IgG AUC (Y axis) plotted against $NT_{50}$ (X axis) r=0.83, p<0.0001. FIG. 1e shows anti-RBD IgG AUC (Y axis) plotted against time between the first dose and blood draw (X axis) r=−0.60 p=0.0055. FIG. 1f shows anti-S IgG AUC (Y axis) plotted against time between the first dose and blood draw (X axis) r=−0.62 p=0.0038. FIG. 1g shows $NT_{50}$ (Y axis) plotted against time between the first dose and blood draw (X axis) r=−0.69 p=0.0008. The r and p values for correlations in FIGS. 1c-g were determined by two-tailed Spearman's. FIG. 1h shows examples of neutralization assays, comparing the sensitivity of pseudotyped viruses with WT and RBD mutant SARS-CoV-2 S proteins to vaccinee plasma. FIG. 1i shows $NT_{50}$ values for vaccinee plasma (n=15) neutralization of pseudotyped viruses with WT and the indicated RBD-mutant SARS-CoV-2 S proteins. Statistical significance was determined. All experiments were performed a minimum of 2 times.

FIGS. 2a, 2b, 2c, 2d, 2e, 2f, 2g, and 2h are a set of diagrams showing characterization of memory B cell antibodies. FIG. 2a shows representative flow cytometry plots showing dual AlexaFluor-647-RBD and PE-RBD binding B cells for 4 vaccinees. FIG. 2b, as in FIG. 2a, shows a dot plot summarizing the percentage of RBD binding B cells in 19 vaccinees, in comparison to a cohort of infected individuals assays 1.3 and 6.2 months after infection. The horizontal bars indicate mean values. Statistical significance was determined using a two-tailed Mann-Whitney U-tests. FIG. 2c shows pie charts depicting the distribution of antibody sequences from the 4 individuals in FIG. 2a. The number in the inner circle indicates the number of sequences analyzed. Pie slice size is proportional to the number of clonally related sequences. The black outline indicates the frequency of clonally expanded sequences. FIG. 2d, as in FIG. 2c, is a graph showing relative clonality among 14 vaccinees assayed. Statistical significance was determined using a two-tailed Mann-Whitney U-tests. FIG. 2e is a graph showing relative abundance of human IGVH genes Sequence Read Archive accession SRP010970 and vaccinees. A two-sided binomial test was used to compare the frequency distributions; significant differences are denoted with stars. FIG. 2f shows clonal relationships between sequences from 14 vaccinated individuals (Moderna and Pfizer in Table 2) and naturally infected individuals. Interconnecting lines indicate the relationship between antibodies that share V and J gene segment sequences at both IGH and IGL. FIG. 2g shows number of somatic nucleotide mutations in the IGVH (top) and IGVL (bottom) in vaccinee antibodies (Table 2) compared to natural infection obtained 1.3 or 6.2 months after infection. Statistical significance was determined using the two-tailed Mann-Whitney U-tests, and the horizontal bars indicate mean values. FIG. 2h, as in FIG. 2g, but for CDR3 length.

FIGS. 3a, 3b, and 3c are a set of diagrams showing anti-SARS-CoV-2 RBD monoclonal antibody neutralizing activity. FIG. 3a shows the results of a SARS-CoV-2 pseudovirus neutralization assay. $IC_{50}$ values for antibodies cloned from COVID-19 convalescent patients were measured at 1.3 and 6.2 months as well as antibodies cloned from mRNA-vaccinees. Antibodies with $IC_{50}$ values above 1000 ng/ml were plotted at 1000 ng/ml. Mean of 2 independent experiments. Indicated values represent geometric mean $IC_{50}$ values in ng/ml. Statistical significance was determined using a two-tailed Mann-Whitney U-test. FIG. 3b shows $IC_{50}$ values for 17 selected mAbs for neutralization of wild type and the indicated mutant SARS-CoV-2 pseudoviruses. FIG. 3c shows that antibody selection pressure can drive emergence of S variants in cell culture; the percentage of sequence reads bearing the indicated RBD mutations after a single passage of rVSV/SARS-CoV-2 in the presence of the indicated antibodies is tabulated. Values represent the decimal frequency with which each mutation occurs as assessed by sequencing.

FIGS. 4a, 4b, 4c, 4d, 4e, 4f, 4g, 4h, 4i, 4j, 4k, 4l, 4m, and 4n are a set of diagrams showing cryo-EM reconstructions of Fab-S complexes. Cryo-EM densities for Fab-S complexes (FIGS. 4a-e; FIGS. 4k-l) and close-up views of antibody footprints on RBDs (FIGS. 4f-j; FIGS. 4m-n) are shown for neutralizing mAbs. As expected, due to Fab inter-domain flexibility, cryo-EM densities (FIGS. 4a-e; FIGS. 4k-l) were weak for the Fab $C_H$-$C_L$ domains. Antibody footprints on RBDs (FIGS. 4f-j; FIGS. 4m-n) are presented as Fab $V_H$-$V_L$ domains (cartoon) complexed with the RBD (surface). FIGS. 4a and 4f, C669; FIGS. 4b and 4g, C643; FIGS. 4c and 4h, C603; FIGS. 4d and 4i, C601; FIGS. 4e and 4j, C670; FIGS. 4k and 4m, C666; and FIGS. 4l and 4n, C669. RBD residues K417, N439, N440, E484, and N501 are highlighted. The N343 glycan is shown as a teal sphere. FIG. 4o shows a composite model illustrating targeted epitopes of RBD-specific neutralizing mAbs (shown as $V_H$-$V_L$ domains from panels FIGS. 4a-1) elicited from mRNA vaccines.

FIGS. 5a, 5b, 5c, 5d, 5e, 5f, 5g, 5h, and 5i are a set of diagrams showing characterization of plasma antibodies against SARS-CoV-2. FIGS. 5a, 5b, 5c, 5d, 5e, and 5f show the results of ELISAs measuring plasma reactivity to S (FIGS. 5a, 5c, and 5e) and RBD protein (FIGS. 5b, 5d, and 5f) of 20 vaccinees (grey curves) and 8 controls (black curves). FIG. 5a, Anti-S IgG. FIG. 5b, Anti-RBD IgG. FIG. 5c, Anti-S IgM. FIG. 5d, Anti-RBD IgM. FIG. 5e, Anti-S IgA. FIG. 5f, Anti-RBD IgA. Left, optical density at 450 nm (OD 450 nm) for the indicated reciprocal plasma dilutions. Right, normalized area under the curve (AUC) values for the 8 controls and 20 vaccinees. Horizontal bars indicate geometric mean. Statistical significance was determined using the two-tailed Mann-Whitney U-test. Average of two or more experiments. FIGS. 5g, 5h, and 5i show correlations of plasma antibodies measurements. FIG. 5g shows normalized AUC for IgG anti-S plotted against normalized AUC for IgG anti-RBD. FIG. 5h shows normalized AUC for IgM anti-S plotted against normalized AUC for IgM anti-RBD. FIG. 5i shows normalized AUC for IgA anti-S plotted against normalized AUC for IgA anti-RBD. The r and p values in FIGS. 5g-i were determined with the two-tailed Spearman's correlation test.

FIGS. 6a, 6b, 6c, 6d, 6e, 6f, 6g, 6h, 6i, and 6j are a set of diagrams showing plasma neutralizing activity and binding correlations. FIG. 6a shows anti-S IgM AUC (Y axis) plotted against $NT_{50}$ (X axis) r=0.12, p<0.6179. FIG. 6b shows anti-S IgA AUC (Y axis) plotted against $NT_{50}$ (X axis) r=0.79, p<0.0001. FIG. 6c shows anti-RBD IgM AUC (Y axis) plotted against $NT_{50}$ (X axis) r=−0.05 p=0.8502. FIG. 6d shows anti-RBD IgA AUC (Y axis) plotted against $NT_{50}$ (X axis) r=0.70 p=0.0006. FIG. 6e shows $NT_{50}$ (Y axis) plotted against time between last dose and blood draw (X axis) r=−0.63 p=0.0032. FIG. 6f shows $NT_{50}$ (Y axis) plotted against time between doses (X axis) r=0.03 p=0.8906. FIG. 6g shows anti-RBD IgG AUC (Y axis) plotted against time between last dose and blood draw (X axis) r=−0.57 p=0.0084. FIG. 6h shows anti-S IgG AUC (Y axis) plotted against time between last dose and blood draw (X axis) r=−0.59 p=0.0064. FIG. 6i shows Age (Y axis) plotted against $NT_{50}$ (X axis) r=−0.06 p=0.8150. The r and p values were determined by two-tailed Spearman's. FIG. 6j shows $NT_{50}$ values for vaccinee plasma neutralization of pseudotyped viruses with WT and the indicated RBD-mutant SARS-CoV-2 S proteins.

FIGS. 7a, 7b, 7c, and 7d are a set of diagrams showing the results of flow cytometry. FIG. 7a shows gating strategy used for cell sorting. Gating was on singlets that were CD20+ and CD3−CD8−CD16−OVA−. Sorted cells were RBD-PE+ and RBD-AF647+. FIG. 7b shows the results of flow cytometry depicting the percentage of RBD-double positive memory B cells from a pre-COVID-19 control (HD) and 15 vaccinees. FIG. 7c shows the percentage of RBD-binding memory B cells in vaccinees (Y axis) plotted against time between the first dose and blood draw (X axis) r=0.4028 p=0.0873 (left panel), and between last dose and blood draw (X axis) r=0.3319 p=0.1651 (right panel). FIG. 7d shows pie charts depicting the distribution of antibody sequences from 10 individuals in FIG. 7b. The number in the inner circle indicates the number of sequences analyzed. Pie slice size is proportional to the number of clonally related sequences. The black outline indicates the frequency of clonally expanded sequences. The r and p values for correlations in FIG. 7c was determined by two-tailed Spearman's.

FIG. 8a is a graph showing relative abundance of human IGVK (left) and IgVL (right) genes of Sequence Read Archive accession SRP010970 and vaccinees. Two-sided binomial tests with unequal variance were used to compare the frequency distributions, significant differences are denoted with stars. (*p<0.05, p<0.01, *p<0.001, ****=p<0.0001). FIG. 8b shows sequences from 14 individuals (Table 2) with clonal relationships depicted as in FIG. 8a. Interconnecting lines indicate the relationship between antibodies that share V and J gene segment sequences at both IGH and IGL.

FIG. 9a shows number of somatic nucleotide mutations in both the IGVH and IGVL in 14 participants (left). For each individual, the number of the amino acid length of the CDR3s at the IGVH and IGVL is shown (right). The horizontal bars indicate the mean. The number of antibody sequences (IGVH and IGVL) evaluated for each participant are n=68 (MOD1), n=45 (MOD2), n=117 (MOD3), n=123 (MOD4), n=110 (MOD6), n=109 (MOD7), n=144 (MOD8), n=102 (MOD9), n=132 (PFZ10), n=109 (MOD11), n=91 (PFZ12), n=78 (C001), n=66 (C003), and n=115 (C004). FIG. 9b shows distribution of the hydrophobicity GRAVY scores at the IGH CDR3 compared to a public database (see Methods for statistical analysis). The box limits are at the lower and upper quartiles, the center line indicates the median, the whiskers are 1.5× interquartile range, and the dots represent outliers. Statistical significance was determined using two-tailed Wilcoxon matched-pairs signed rank test (n.s.=non-significant, ****=p<0.0001).

FIGS. 10a, 10b, 10c, 10d, 10e, 10f, 10g, 10h, 10i, 10j, 10k and 10l are a set of diagrams showing the results of monoclonal antibody ELISAs. FIG. 10a is a graph showing antibody binding to SARS-CoV-2 RBD. ELISA $EC_{50}$ (half-maximal response) values for 84 antibodies isolated from Moderna vaccinees measured at 8 weeks after the boost and from convalescent individuals at 1.3 and 6.2 months. Horizontal bars indicate a geometric mean. Statistical significance was determined using a two-tailed Mann-Whitney U-test. Average of two or more experiments. FIGS. 10b-k are graphs showing ELISA titrations for antibodies in FIG. 10a. n=84 samples and isotype and control antibodies as indicated in the figure. FIG. 10l is a table showing a heat map summary of $EC_{50}$ values for binding to wild type RBD and the indicated mutants for 17 selected antibodies.

DETAILED DESCRIPTION OF THE INVENTION

Figure 5A:
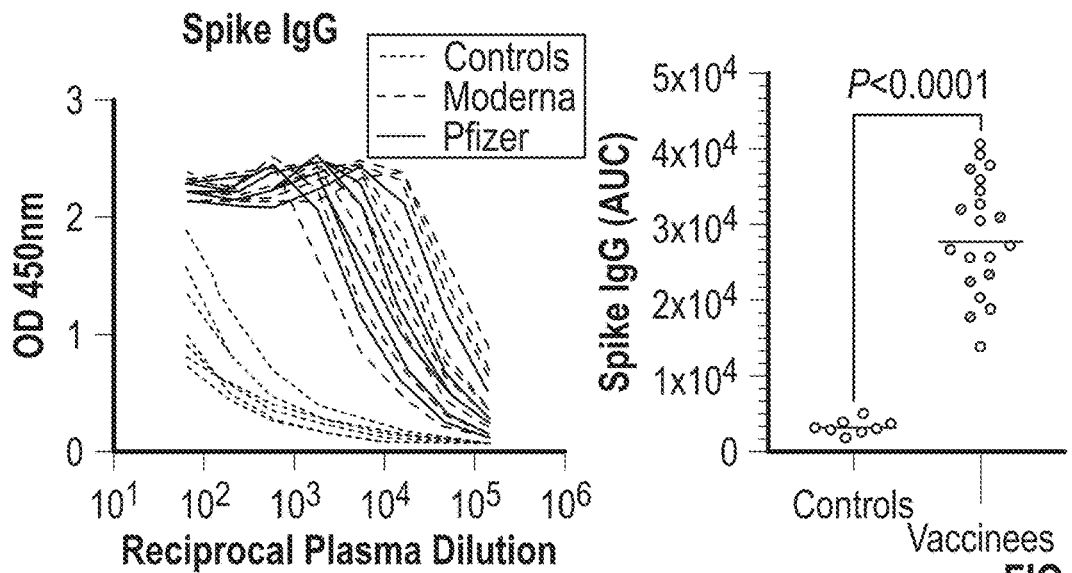
Figure 5B:
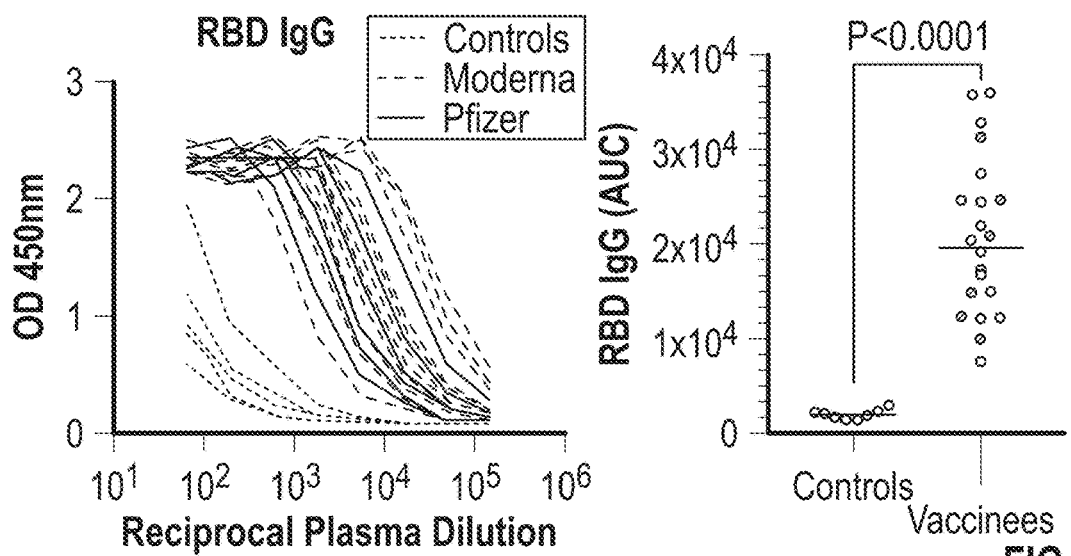
Figure 5C:
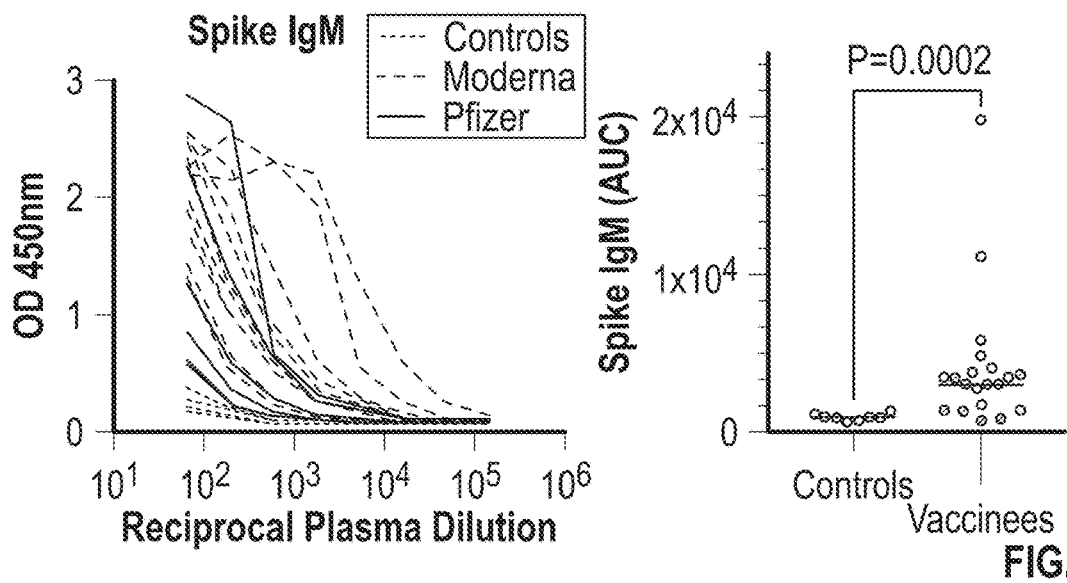
Figure 5D:
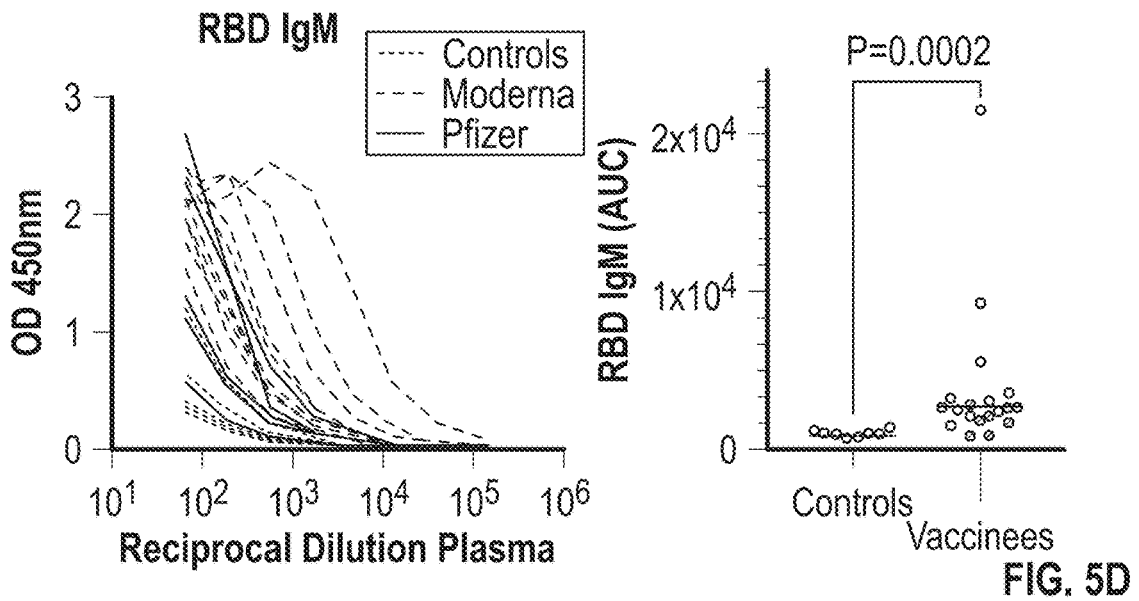
Figure 5E:
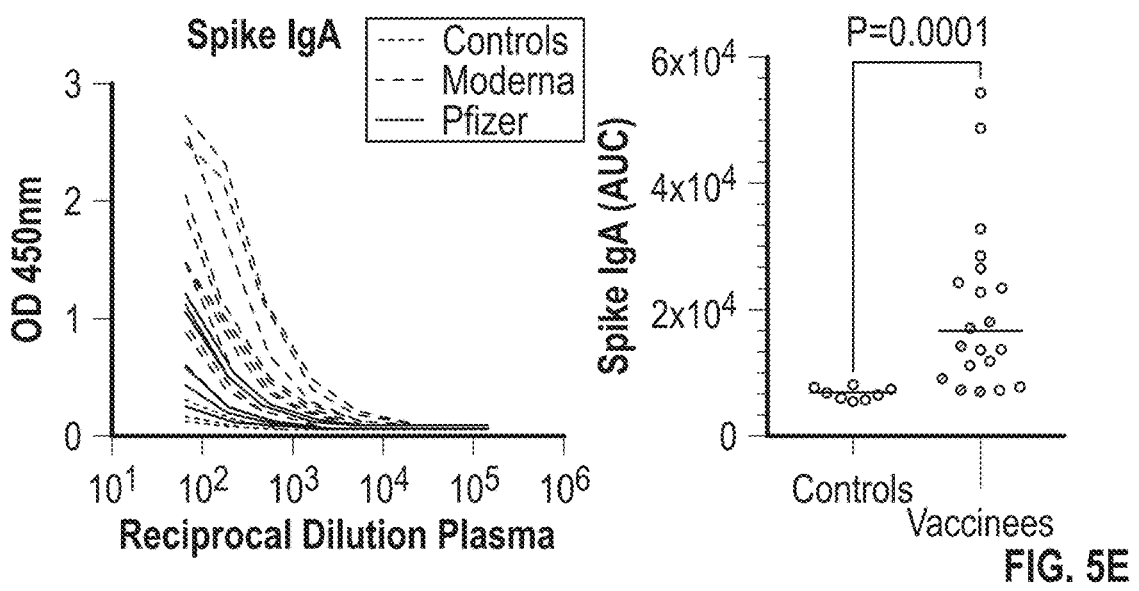
Figure 5F:
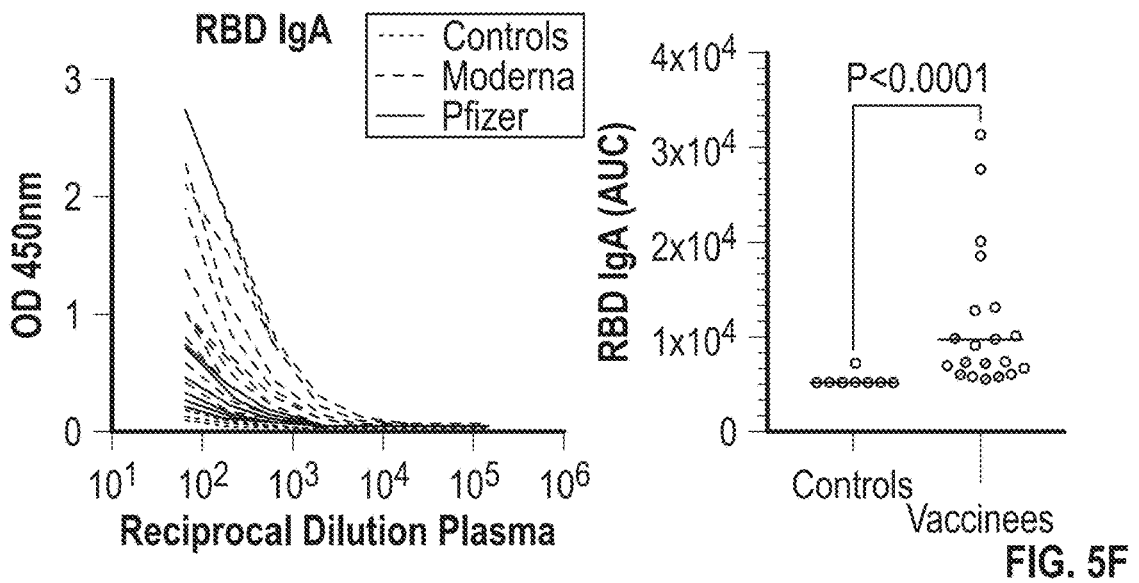

SARS-CoV-2 represents a serious public health concern. Methods to diagnose and treat persons who are infected with SARS-CoV-2 provide the opportunity to either prevent or control further spread of infection by SARS-CoV-2. These methods are especially important due to the ability of SARS-CoV-2 to infect persons through an airborne route.

This invention is based, at least in part, on unexpected neutralizing activities of the disclosed anti-SARS-CoV-2 antibodies or antigen-binding fragments thereof. These antibodies and antigen-binding fragments constitute a novel therapeutic strategy in protection from SARS-CoV-2 infections.

Neutralizing Anti-SARS-CoV-2 Antibodies
Antibodies

The invention disclosed herein involves neutralizing anti-SARS-CoV-2 antibodies or antigen-binding fragments thereof. These antibodies refer to a class of neutralizing antibodies that neutralize multiple SARS-CoV-2 virus strains. The antibodies are able to protect a subject prophylactically and therapeutically against a lethal challenge with a SARS-CoV-2 virus.

In one aspect, this disclosure provides an isolated anti-SARS-CoV-2 antibody or antigen-binding fragment thereof that binds specifically to a SARS-CoV-2 antigen. In some embodiments, the SARS-CoV-2 antigen comprises a portion of a Spike (S) polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide. In some embodiments, the antibody or antigen-binding fragment thereof is capable of neutralizing a plurality of SARS-CoV-2 strains.

In some embodiments, the antibody or antigen-binding fragment thereof is capable of neutralizing a SARS-CoV-2 virus at an $IC_{50}$ concentration of less than 50 (e.g., 1, 5, 10, 20, 30, 40, 50) μg/ml.

The spike protein is important because it is present on the outside of intact SARS-CoV-2. Thus, it presents a target that can be used to inhibit or eliminate an intact virus before the virus has an opportunity to infect a cell. A representative amino acid sequence is provided below:

(Accession ID: NC_045512.2)
(SEQ ID NO: 357)
MFVFLVLLPLVSSQCVNLTTRTQLPPAYTNSFTRGVYYPDKVFRSSVLHS

TQDLFLPFFSNVTWFHAIHVSGTNGTKRFDNPVLPFNDGVYFASTEKSNI

-continued
IRGWIFGTTLDSKTQSLLIVNNATNVVIKVCEFQFCNDPFLGVYYHKNNK

SWMESEFRVYSSANNCTFEYVSQPFLMDLEGKQGNFKNLREFVFKNIDGY

FKIYSKHTPINLVRDLPQGFSALEPLVDLPIGINITRFQTLLALHRSYLT

PGDSSSGWTAGAAAYYVGYLQPRTFLLKYNENGTITDAVDCALDPLSETK

CTLKSFTVEKGIYQTSNFRVQPTESIVRFPNITNLCPFGEVFNATRFASV

YAWNRKRISNCVADYSVLYNSASFSTFKCYGVSPTKLNDLCFTNVYADSF

VIRGDEVRQIAPGQTGKIADYNYKLPDDFTGCVIAWNSNNLDSKVGGNYN

YLYRLFRKSNLKPFERDISTEIYQAGSTPCNGVEGFNCYFPLQSYGFQPT

NGVGYQPYRVVVLSFELLHAPATVCGPKKSTNLVKNKCVNFNFNGLTGTG

VLTESNKKFLPFQQFGRDIADTTDAVRDPQTLEILDITPCSFGGVSVITP

GTNTSNQVAVLYQDVNCTEVPVAIHADQLTPTWRVYSTGSNVFQTRAGCL

IGAEHVNNSYECDIPIGAGICASYQTQTNSPRRARSVASQSIIAYTMSLG

AENSVAYSNNSIAIPTNFTISVTTEILPVSMTKTSVDCTMYICGDSTECS

NLLLQYGSFCTQLNRALTGIAVEQDKNTQEVFAQVKQIYKTPPIKDFGGF

NFSQILPDPSKPSKRSFIEDLLFNKVTLADAGFIKQYGDCLGDIAARDLI

CAQKFNGLTVLPPLLTDEMIAQYTSALLAGTITSGWTFGAGAALQIPFAM

QMAYRFNGIGVTQNVLYENQKLIANQFNSAIGKIQDSLSSTASALGKLQD

VVNQNAQALNTLVKQLSSNFGAISSVLNDILSRLDKVEAEVQIDRLITGR

LQSLQTYVTQQLIRAAEIRASANLAATKMSECVLGQSKRVDFCGKGYHLM

SFPQSAPHGVVFLHVTYVPAQEKNFTTAPAICHDGKAHFPREGVFVSNGT

HWFVTQRNFYEPQIITTDNTFVSGNCDVVIGIVNNTVYDPLQPELDSFKE

ELDKYFKNHTSPDVDLGDISGINASVVNIQKEIDRLNEVAKNLNESLIDL

QELGKYEQYIKWPWYIWLGFIAGLIAIVMVTIMLCCMTSCCSCLKGCCSC

GSCCKFDEDDSEPVLKGVKLHYT

Listed below in Tables 2 and 4 are amino acid sequences of the heavy chain (HC) variable regions and light chain (LC) variable regions of exemplary antibodies.

In some embodiments, the antibody or antigen-binding fragment thereof comprises: three heavy chain complementarity determining regions (HCDRs) (HCDR1, HCDR2, and HCDR3) of a heavy chain variable region having the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, or 167; and three light chain CDRs (LCDR1, LCDR2, and LCDR3) of a light chain variable region having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, or 168.

In some embodiments, the antibody or antigen-binding fragment thereof comprises: (i) a heavy chain variable region having an amino acid sequence with at least 75% identity to one selected from those in Table 2 or 4; and/or (ii) a light chain variable region having an amino acid sequence with at least 75% identity to one selected from those in Table 2 or 4.

In some embodiments, the antibody or antigen-binding fragment thereof comprises: (i) a heavy chain variable region having the amino acid sequence of one selected from those in Table 2 or 4; and/or (ii) a light chain variable region having the amino acid sequence of one selected from those in Table 2 or 4.

In some embodiments, the antibody or antigen-binding fragment thereof comprises a heavy chain variable region and a light chain variable region that comprises an amino acid sequence pair selected from those in Table 2 or 4.

In some embodiments, the antibody or antigen-binding fragment thereof comprises: a heavy chain variable region having an amino acid sequence with at least 75% identity to the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, or 167; or having the amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, or 167; and a light chain variable region having an amino acid sequence with at least 75% identity to the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, or 168; or having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, or 168.

In some embodiments, the antibody or antigen-binding fragment thereof comprises a heavy chain variable region and a light chain variable region comprise the respective amino acid sequences of SEQ ID NOs: 1-2, 3-4, 5-6, 7-8, 9-10, 11-12, 13-14, 15-16, 17-18, 19-20, 21-22, 23-24, 25-26, 27-28, 29-30, 31-32, 33-34, 35-36, 37-38, 39-40, 41-42, 43-44, 45-46, 47-48, 49-50, 51-52, 53-54, 55-56, 57-58, 59-60, 61-62, 63-64, 65-66, 67-68, 69-70, 71-72, 73-74, 75-76, 77-78, 79-80, 81-82, 83-84, 85-86, 87-88, 89-90, 91-92, 93-94, 95-96, 97-98, 99-100, 101-102, 103-104, 105-106, 107-108, 109-110, 111-112, 113-114, 115-116, 117-118, 119-120, 121-122, 123-124, 125-126, 127-128, 129-130, 131-132, 133-134, 135-136, 137-138, 139-140, 141-142, 143-144, 145-146, 147-148, 149-150, 151-152, 153-154, 155-156, 157-158, 159-160, 161-162, 163-164, 165-166, or 167-168.

In some embodiments, the antibody or antigen-binding fragment thereof comprises (a) a first target binding site that specifically binds to an epitope within the S polypeptide, and (b) a second target binding site that binds to a different epitope on the S polypeptide or on a different molecule. In some embodiments, the multivalent antibody is a bivalent or bispecific antibody.

In some embodiments, the antibody or the antigen-binding fragment thereof further comprises a variant Fc constant region. In some embodiments, the antibody is a monoclonal antibody. In some embodiments, the antibody is a chimeric antibody, a humanized antibody, or a humanized monoclonal antibody. In some embodiments, the antibody is a single-chain antibody, Fab or Fab2 fragment.

In some embodiments, the antibody or the antigen-binding fragment thereof further comprises a variant Fc constant region. The antibody can be a monoclonal antibody. In some embodiments, the antibody can be a chimeric antibody, a humanized antibody, or a humanized monoclonal antibody. In some embodiments, the antibody can be a single-chain antibody, Fab or Fab2 fragment.

In some embodiments, the antibody or antigen-binding fragment thereof can be detectably labeled or conjugated to a toxin, a therapeutic agent, a polymer (e.g., polyethylene glycol (PEG)), a receptor, an enzyme, or a receptor ligand. For example, an antibody of the present invention may be coupled to a toxin (e.g., a tetanus toxin). Such antibodies may be used to treat animals, including humans, that are infected with the virus that is etiologically linked to SARS-CoV-2. The toxin-coupled antibody is thought to bind to a portion of a spike protein presented on an infected cell, and then kill the infected cell.

In another example, an antibody of the present invention may be coupled to a detectable tag. Such antibodies may be used within diagnostic assays to determine if an animal, such as a human, is infected with SARS-CoV-2. Examples of detectable tags include: fluorescent proteins (i.e., green fluorescent protein, red fluorescent protein, yellow fluorescent protein), fluorescent markers (i.e., fluorescein isothiocyanate, rhodamine, texas red), radiolabels (i.e., 3H, 32P, 125I), enzymes (i.e., β-galactosidase, horseradish peroxidase, β-glucuronidase, alkaline phosphatase), or an affinity tag (i.e., avidin, biotin, streptavidin). Methods to couple antibodies to a detectable tag are known in the art. Harlow et al., Antibodies: A Laboratory Manual, page 319 (Cold Spring Harbor Pub. 1988).

Fragment

In some embodiments, an antibody provided herein is an antibody fragment. Antibody fragments include, but are not limited to, Fab, Fab', Fab'-SH, F(ab')2, Fv, and single-chain Fv (scFv) fragments, and other fragments described below, e.g., diabodies, triabodies tetrabodies, and single-domain antibodies. For a review of certain antibody fragments, see Hudson et al., Nat. Med. 9:129-134 (2003). For a review of scFv fragments, see, e.g., Pluckthun, in The Pharmacology of Monoclonal Antibodies, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869, 046.

Diabodies are antibody fragments with two antigen-binding sites that may be bivalent or bispecific. See, for example, EP 404,097; WO 1993/01161; Hudson et al., Nat. Med. 9:129-134 (2003); and Hollinger et al., Proc. Natl. Acad. Sci. USA 90: 6444-6448 (1993). Triabodies and tetrabodies are also described in Hudson et al., Nat. Med. 9:129-134 (2003).

Single-domain antibodies are antibody fragments comprising all or a portion of the heavy chain variable domain or all or a portion of the light chain variable domain of an antibody. In some embodiments, a single-domain antibody is a human single-domain antibody (DOMANTIS, Inc., Waltham, Mass.; see, e.g., U.S. Pat. No. 6,248,516).

Antibody fragments can be made by various techniques, including but not limited to proteolytic digestion of an intact antibody as well as production by recombinant host cells (e.g., *E. coli* or phage), as described herein.

Chimeric and Humanized Antibodies

In some embodiments, an antibody provided herein is a chimeric antibody. Certain chimeric antibodies are described, e.g., in U.S. Pat. No. 4,816,567; and Morrison et al., Proc. Natl. Acad. Sci. USA, 81:6851-6855 (1984)). In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof.

In some embodiments, a chimeric antibody is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

Humanized antibodies and methods of making them are reviewed, e.g., in Almagro and Fransson, Front. Biosci. 13:1619-1633 (2008), and are further described, e.g., in Riechmann et al., Nature 332:323-329 (1988); Queen et al., Proc. Nat'l Acad. Sci. USA 86:10029-10033 (1989); U.S. Pat. Nos. 5,821,337, 7,527,791, 6,982,321, and 7,087,409; Kashmiri et al., Methods 36:25-34 (2005) (describing specificity determining region (SDR) grafting); Padlan, Mol. Immunol. 28:489-498 (1991) (describing "resurfacing"); Dall'Acqua et al., Methods 36:43-60 (2005) (describing "FR shuffling"); and Osbourn et al., Methods 36:61-68 (2005) and Klimka et al., Br. J. Cancer, 83:252-260 (2000) (describing the "guided selection" approach to FR shuffling).

Human framework regions that may be used for humanization include but are not limited to: framework regions selected using the "best-fit" method (see, e.g., Sims et al. J. Immunol. 151:2296 (1993)); framework regions derived from the consensus sequence of human antibodies of a particular subgroup of light or heavy chain variable regions (see, e.g., Carter et al. Proc. Natl. Acad. Sci. USA, 89:4285 (1992); and Presta et al. J. Immunol., 151:2623 (1993)); human mature (somatically mutated) framework regions or human germline framework regions (see, e.g., Almagro and Fransson, Front. Biosci. 13:1619-1633 (2008)); and framework regions derived from screening FR libraries (see, e.g., Baca et al., J. Biol. Chem. 272:10678-10684 (1997) and Rosok et al., J. Biol. Chem. 271:22611-22618 (1996)).

Human Antibodies

In some embodiments, an antibody provided herein is a human antibody. Human antibodies can be produced using various techniques known in the art or using techniques described herein. Human antibodies are described generally in van Dijk and van de Winkel, Curr. Opin. Pharmacol. 5: 368-74 (2001) and Lonberg, Curr. Opin. Immunol. 20:450-459 (2008).

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For review of methods for obtaining human antibodies from transgenic animals, see Lonberg, Nat. Biotech. 23:1117-1125 (2005). See also, e.g., U.S. Pat. Nos. 6,075,181 and 6,150,584 describing XENO-MOUSE technology; U.S. Pat. No. 5,770,429 describing HUMAB technology; U.S. Pat. No. 7,041,870 describing K-M MOUSE technology, and U.S. Patent Application Publication No. US 2007/0061900, describing VELOCI-MOUSE technology). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described. (See, e.g., Kozbor J. Immunol., 133: 3001 (1984); Brodeur et al., Monoclonal Antibody Production Techniques and Applications, pp. 51-63 (Marcel Dekker, Inc., New York, 1987); and Boerner et al., J. Immunol., 147: 86 (1991).) Human antibodies generated via human B-cell hybridoma technology are also described in Li et al., Proc. Natl. Acad. Sci. USA, 103:3557-3562 (2006). Additional methods include those described, for example, in U.S. Pat. No. 7,189,826 (describing production of monoclonal human IgM antibodies from hybridoma cell lines) and Ni, Xiandai Mianyixue, 26(4):265-268 (2006) (describing human-human hybridomas). Human hybridoma technology (Trioma technology) is also described in Vollmers and Brandlein, Histology and Histopathology, 20(3): 927-937 (2005) and Vollmers and Brandlein, Methods and Findings in Experimental and Clinical Pharmacology, 27(3): 185-91 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described below.

Antibodies of the invention may be isolated by screening combinatorial libraries for antibodies with the desired activity or activities. For example, a variety of methods are known in the art for generating phage display libraries and screening such libraries for antibodies possessing the desired binding characteristics. Such methods are reviewed, e.g., in Hoogenboom et al., in Methods in Molecular Biology 178: 1-37 (O'Brien et al., ed., Human Press, Totowa, N.J., 2001) and further described, e.g., in the McCafferty et al., Nature 348:552-554; Clackson et al., Nature 352: 624-628 (1991); Marks et al., J. Mol. Biol. 222: 581-597 (1992); Marks and Bradbury, in Methods in Molecular Biology 248:161-175 (Lo, ed., Human Press, Totowa, N.J., 2003); Sidhu et al., J. Mol. Biol. 338(2): 299-310 (2004); Lee et al., J. Mol. Biol. 340(5): 1073-1093 (2004); Fellouse, Proc. Natl. Acad. Sci. USA 101(34): 12467-12472 (2004); and Lee et al., J. Immunol. Methods 284(1-2): 119-132 (2004).

In certain phage display methods, repertoires of VH and VL genes are separately cloned by polymerase chain reaction (PCR) and recombined randomly in phage libraries, which can then be screened for antigen-binding phage as described in Winter et al., Ann. Rev. Immunol., 12: 433-455 (1994). Phage typically displays antibody fragments, either as scFv fragments or as Fab fragments. Libraries from immunized sources provide high-affinity antibodies to the immunogen without the requirement of constructing hybridomas. Alternatively, the naive repertoire can be cloned (e.g., from human) to provide a single source of antibodies to a wide range of non-self and also self-antigens without any immunization as described by Griffiths et al., EMBO J, 12: 725-734 (1993). Finally, naive libraries can also be made synthetically by cloning unrearranged V-gene segments from stem cells and using PCR primers containing random sequence to encode the highly variable CDR3 regions and to accomplish rearrangement in vitro, as described by Hoogenboom and Winter, J. Mol. Biol., 227: 381-388 (1992). Patent publications describing human antibody phage libraries include, for example, U.S. Pat. No. 5,750,373, and US Patent Publication Nos. 2005/0079574, 2005/0119455, 2005/0266000, 2007/0117126, 2007/0160598, 2007/0237764, 2007/0292936, and 2009/0002360. Antibodies or antibody fragments isolated from human antibody libraries are considered human antibodies or human antibody fragments herein.

Variants

In some embodiments, amino acid sequence variants of the antibodies provided herein are contemplated. For example, it may be desirable to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen binding.

Substitution, Insertion, and Deletion Variants

In some embodiments, antibody variants having one or more amino acid substitutions are provided. Sites of interest for substitutional mutagenesis include the HVRs and FRs. Conservative substitutions are defined herein. Amino acid substitutions may be introduced into an antibody of interest and the products screened for a desired activity, e.g., retained/improved antigen binding, decreased immunogenicity, or improved antibody-dependent cell-mediated cytotoxicity (ADCC) and complement-dependent cytotoxicity (CDC).

Accordingly, an antibody of the invention can comprise one or more conservative modifications of the CDRs, heavy chain variable region, or light variable regions described herein. A conservative modification or functional equivalent of a peptide, polypeptide, or protein disclosed in this invention refers to a polypeptide derivative of the peptide, polypeptide, or protein, e.g., a protein having one or more point mutations, insertions, deletions, truncations, a fusion protein, or a combination thereof. It substantially retains the activity to of the parent peptide, polypeptide, or protein (such as those disclosed in this invention). In general, a conservative modification or functional equivalent is at least 60% (e.g., any number between 60% and 100%, inclusive, e.g., 60%, 70%, 75%, 80%, 85%, 90%, 95%, 96%, 97%, 98%, and 99%) identical to a parent. Accordingly, within the scope of this invention are heavy chain variable region or light variable regions having one or more point mutations, insertions, deletions, truncations, a fusion protein, or a combination thereof, as well as antibodies having the variant regions.

As used herein, the percent homology between two amino acid sequences is equivalent to the percent identity between the two sequences. The percent identity between the two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two amino acid sequences can be determined using the algorithm of E. Meyers and W. Miller (Comput. Appl. Biosci., 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. 48:444-453 (1970)) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6.

Additionally or alternatively, the protein sequences of the present invention can further be used as a "query sequence" to perform a search against public databases to, for example, identify related sequences. Such searches can be performed using the XBLAST program (version 2.0) of Altschul, et al. (1990) J. Mol. Biol. 215:403-10. BLAST protein searches can be performed with the XBLAST program, score=50, wordlength=3 to obtain amino acid sequences homologous to the antibody molecules of the invention. To obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., XBLAST and NBLAST) can be used. (See www.ncbi.nlm.nih.gov).

As used herein, the term "conservative modifications" refers to amino acid modifications that do not significantly affect or alter the binding characteristics of the antibody containing the amino acid sequence. Such conservative modifications include amino acid substitutions, additions and deletions. Modifications can be introduced into an antibody of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include: (i) amino acids with basic side chains (e.g., lysine, arginine, histidine), (ii) acidic side chains (e.g., aspartic acid, glutamic acid), (iii) uncharged polar side chains (e.g., glycine, asparagine, glutamine, serine, threonine, tyrosine, cysteine, tryptophan), (iv) nonpolar side chains (e.g., alanine, valine, leucine, isoleucine, proline, phenylalanine, methionine), (v) beta-branched side chains (e.g., threonine, valine, isoleucine), and (vi) aromatic side chains (e.g., tyrosine, phenylalanine, tryptophan, histidine). Non-conservative substitutions will entail exchanging a member of one of these classes for another class.

An exemplary substitutional variant is an affinity matured antibody, which may be conveniently generated, e.g., using phage display-based affinity maturation techniques such as those described in, e.g., Hoogenboom et al., in Methods in Molecular Biology 178:1-37 (O'Brien et al., ed., Human Press, Totowa, N.J., (2001). Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g., for ADEPT) or a polypeptide which increases the serum half-life of the antibody.

Glycosylation Variants

In some embodiments, an antibody provided herein is altered to increase or decrease the extent to which the antibody is glycosylated. Addition or deletion of glycosylation sites to an antibody may be conveniently accomplished by altering the amino acid sequence such that one or more glycosylation sites are created or removed.

For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen. Such an approach is described in further detail in U.S. Pat. Nos. 5,714,350 and 6,350,861 by Co et al.

Glycosylation of the constant region on N297 may be prevented by mutating the N297 residue to another residue, e.g., N297A, and/or by mutating an adjacent amino acid, e.g., 298 to thereby reduce glycosylation on N297.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies described herein to thereby produce an antibody with altered glycosylation. For example, EP 1,176,195 by Hanai et al. describes a cell line with a functionally disrupted FUT8 gene, which encodes a fucosyltransferase, such that antibodies expressed in such a cell line exhibit hypofucosylation. PCT Publication WO 03/035835 by Presta describes a variant Chinese Hamster Ovary cell line, Lcd 3 cells, with reduced ability to attach fucose to Asn(297)-linked carbohydrates, also resulting in hypofucosylation of antibodies expressed in that host cell (see also Shields, R. L. et al. (2002) J. Biol. Chem. 277:26733-26740). PCT Publication WO 99/54342 by Umana et al. describes cell lines engineered to express glycoprotein-modifying glycosyltransferases (e.g., beta(1,4)-N-acetylglucosaminyltransferase III (GnTIII)) such that antibodies expressed in the engineered cell lines exhibit increased bisecting GlcNac structures which result in increased ADCC activity of the antibodies (see also Umana et al. (1999) Nat. Biotech. 17: 176-180).

Ec Region Variants

The variable regions of the antibody described herein can be linked (e.g., covalently linked or fused) to an Fc, e.g., an IgG1, IgG2, IgG3 or IgG4 Fc, which may be of any allotype or isoallotype, e.g., for IgG1: Glm, Glm1(a), Glm2(x), Glm3(f), Glm17(z); for IgG2: G2m, G2m23(n); for IgG3: G3m, G3m21(g1), G3m28(g5), G3m11(b0), G3m5(b1), G3m13(b3), G3m14(b4), G3m10(b5), G3m15(s), G3m16(t), G3m6(c3), G3m24(c5), G3m26(u), G3m27(v); and for K: Km, Km1, Km2, Km3 (see, e.g., Jefferies et al. (2009) mAbs 1: 1). In some embodiments, the antibodies variable regions described herein are linked to an Fc that binds to one or more activating Fc receptors (FcγI, FcγIIa or FcγIIIa), and thereby stimulate ADCC and may cause T cell depletion. In some embodiments, the antibody variable regions described herein are linked to an Fc that causes depletion.

In some embodiments, the antibody variable regions described herein may be linked to an Fc comprising one or more modifications, typically to alter one or more functional properties of the antibody, such as serum half-life, complement fixation, Fc receptor binding, and/or antigen-dependent cellular cytotoxicity. Furthermore, an antibody described herein may be chemically modified (e.g., one or more chemical moieties can be attached to the antibody) or be modified to alter its glycosylation, to alter one or more functional properties of the antibody. The numbering of residues in the Fc region is that of the EU index of Kabat.

The Fc region encompasses domains derived from the constant region of an immunoglobulin, preferably a human immunoglobulin, including a fragment, analog, variant, mutant or derivative of the constant region. Suitable immunoglobulins include IgG1, IgG2, IgG3, IgG4, and other classes such as IgA, IgD, IgE and IgM. The constant region of an immunoglobulin is defined as a naturally-occurring or synthetically-produced polypeptide homologous to the immunoglobulin C-terminal region, and can include a CH1 domain, a hinge, a CH2 domain, a CH3 domain, or a CH4 domain, separately or in combination. In some embodiments, an antibody of this invention has an Fc region other than that of a wild type IgA1. The antibody can have an Fc region from that of IgG (e.g., IgG1, IgG2, IgG3, and IgG4) or other classes such as IgA2, IgD, IgE, and IgM. The Fc can be a mutant form of IgA1.

The constant region of an immunoglobulin is responsible for many important antibody functions, including Fc receptor (FcR) binding and complement fixation. There are five major classes of heavy chain constant region, classified as IgA, IgG, IgD, IgE, IgM, each with characteristic effector functions designated by isotype. For example, IgG is separated into four subclasses known as IgG1, IgG2, IgG3, and IgG4.

Ig molecules interact with multiple classes of cellular receptors. For example, IgG molecules interact with three classes of Fcγ receptors (FcγR) specific for the IgG class of antibody, namely FcγRI, FcγRII, and FcγRIII. The important sequences for the binding of IgG to the FcγR receptors have been reported to be located in the CH2 and CH3 domains. The serum half-life of an antibody is influenced by the ability of that antibody to bind to an FcR.

In some embodiments, the Fc region is a variant Fc region, e.g., an Fc sequence that has been modified (e.g., by amino acid substitution, deletion and/or insertion) relative to a parent Fc sequence (e.g., an unmodified Fc polypeptide that is subsequently modified to generate a variant), to provide desirable structural features and/or biological activity. For example, one may make modifications in the Fc region in order to generate an Fc variant that (a) has increased or decreased ADCC, (b) increased or decreased CDC, (c) has increased or decreased affinity for Clq and/or (d) has increased or decreased affinity for an Fc receptor relative to the parent Fc. Such Fc region variants will generally comprise at least one amino acid modification in the Fc region. Combining amino acid modifications is thought to be particularly desirable. For example, the variant Fc region may include two, three, four, five, etc. substitutions therein, e.g., of the specific Fc region positions identified herein.

A variant Fc region may also comprise a sequence alteration wherein amino acids involved in disulfide bond formation are removed or replaced with other amino acids. Such removal may avoid reaction with other cysteine-containing proteins present in the host cell used to produce the antibodies described herein. Even when cysteine residues are removed, single chain Fc domains can still form a dimeric Fc domain that is held together non-covalently. In other embodiments, the Fc region may be modified to make it more compatible with a selected host cell. For example, one may remove the PA sequence near the N-terminus of a typical native Fc region, which may be recognized by a digestive enzyme in *E. coli* such as proline iminopeptidase. In other embodiments, one or more glycosylation sites within the Fc domain may be removed. Residues that are typically glycosylated (e.g., asparagine) may confer cytolytic response. Such residues may be deleted or substituted with unglycosylated residues (e.g., alanine). In other embodiments, sites involved in interaction with complement, such as the Clq binding site, may be removed from the Fc region. For example, one may delete or substitute the EKK sequence of human IgG1. In some embodiments, sites that affect binding to Fc receptors may be removed, preferably sites other than salvage receptor binding sites. In other embodiments, an Fc region may be modified to remove an ADCC site. ADCC sites are known in the art; see, for example, Molec. Immunol. 29 (5): 633-9 (1992) with regard to ADCC sites in IgG1. Specific examples of variant Fc domains are disclosed, for example, in WO 97/34631 and WO 96/32478.

In one embodiment, the hinge region of Fc is modified such that the number of cysteine residues in the hinge region is altered, e.g., increased or decreased. This approach is described further in U.S. Pat. No. 5,677,425 by Bodmer et al. The number of cysteine residues in the hinge region of Fc is altered to, for example, facilitate assembly of the light and heavy chains or to increase or decrease the stability of the antibody. In one embodiment, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired Staphylococcal protein A (SpA) binding relative to native Fc-hinge domain SpA binding. This approach is described in further detail in U.S. Pat. No. 6,165,745 by Ward et al.

In yet other embodiments, the Fc region is altered by replacing at least one amino acid residue with a different amino acid residue to alter the effector function(s) of the antibody. For example, one or more amino acids selected from amino acid residues 234, 235, 236, 237, 297, 318, 320 and 322 can be replaced with a different amino acid residue such that the antibody has an altered affinity for an effector ligand but retains the antigen-binding ability of the parent antibody. The effector ligand to which affinity is altered can be, for example, an Fc receptor or the CI component of complement. This approach is described in further detail in U.S. Pat. Nos. 5,624,821 and 5,648,260, both by Winter et al.

In another example, one or more amino acids selected from amino acid residues 329, 331 and 322 can be replaced with a different amino acid residue such that the antibody has altered Clq binding and/or reduced or abolished CDC. This approach is described in further detail in U.S. Pat. No. 6,194,551 by Idusogie et al.

In another example, one or more amino acid residues within amino acid positions 231 and 239 are altered to thereby alter the ability of the antibody to fix complement. This approach is described further in PCT Publication WO 94/29351 by Bodmer et al.

In yet another example, the Fc region may be modified to increase ADCC and/or to increase the affinity for an Fcγ receptor by modifying one or more amino acids at the following positions: 234, 235, 236, 238, 239, 240, 241, 243, 244, 245, 247, 248, 249, 252, 254, 255, 256, 258, 262, 263, 264, 265, 267, 268, 269, 270, 272, 276, 278, 280, 283, 285, 286, 289, 290, 292, 293, 294, 295, 296, 298, 299, 301, 303, 305, 307, 309, 312, 313, 315, 320, 322, 324, 325, 326, 327, 329, 330, 331, 332, 333, 334, 335, 337, 338, 340, 360, 373, 376, 378, 382, 388, 389, 398, 414, 416, 419, 430, 433, 434, 435, 436, 437, 438 or 439. Exemplary substitutions include 236A, 239D, 239E, 268D, 267E, 268E, 268F, 324T, 332D, and 332E. Exemplary variants include 239D/332E, 236A/332E, 236A/239D/332E, 268F/324T, 267E/268F, 267E/324T, and 267E/268F7324T. Other modifications for enhancing FcγR and complement interactions include but are not limited to substitutions 298A, 333A, 334A, 326A, 247I, 339D, 339Q, 280H, 290S, 298D, 298V, 243L, 292P, 300L, 396L, 305I, and 396L. These and other modifications are reviewed in Strohl, 2009, Current Opinion in Biotechnology 20:685-691.

Fc modifications that increase binding to an Fcγ receptor include amino acid modifications at any one or more of amino acid positions 238, 239, 248, 249, 252, 254, 255, 256, 258, 265, 267, 268, 269, 270, 272, 279, 280, 283, 285, 298, 289, 290, 292, 293, 294, 295, 296, 298, 301, 303, 305, 307, 312, 315, 324, 327, 329, 330, 335, 337, 3338, 340, 360, 373, 376, 379, 382, 388, 389, 398, 414, 416, 419, 430, 434, 435, 437, 438 or 439 of the Fc region, wherein the numbering of the residues in the Fc region is that of the EU index as in abat (WO00/42072).

Other Fc modifications that can be made to Fcs are those for reducing or ablating binding to FcγR and/or complement proteins, thereby reducing or ablating Fc-mediated effector functions such as ADCC, antibody-dependent cellular phagocytosis (ADCP), and CDC. Exemplary modifications include but are not limited substitutions, insertions, and deletions at positions 234, 235, 236, 237, 267, 269, 325, and 328, wherein numbering is according to the EU index. Exemplary substitutions include but are not limited to 234G, 235G, 236R, 237K, 267R, 269R, 325L, and 328R, wherein numbering is according to the EU index. An Fc variant may comprise 236R/328R. Other modifications for reducing FcγR and complement interactions include substitutions 297A, 234A, 235A, 237A, 318A, 228P, 236E, 268Q, 309L, 330S, 331S, 220S, 226S, 229S, 238S, 233P, and 234V, as well as removal of the glycosylation at position 297 by mutational or enzymatic means or by production in organisms such as bacteria that do not glycosylate proteins. These and other modifications are reviewed in Strohl, 2009, Current Opinion in Biotechnology 20:685-691.

Optionally, the Fc region may comprise a non-naturally occurring amino acid residue at additional and/or alternative positions known to one skilled in the art (see, e.g., U.S. Pat. Nos. 5,624,821; 6,277,375; 6,737,056; 6,194,551; 7,317,091; 8,101,720; WO00/42072; WO01/58957; WO02/06919; WO04/016750; WO04/029207; WO04/035752; WO04/074455; WO04/099249; WO04/063351; WO05/070963; WO05/040217, WO05/092925 and WO06/020114).

Fc variants that enhance affinity for an inhibitory receptor FcγRIIb may also be used. Such variants may provide an Fc fusion protein with immune-modulatory activities related to FcγRIIb cells, including, for example, B cells and monocytes. In one embodiment, the Fc variants provide selectively enhanced affinity to FcγRIIb relative to one or more activating receptors. Modifications for altering binding to FcγRIIb include one or more modifications at a position selected from the group consisting of 234, 235, 236, 237, 239, 266, 267, 268, 325, 326, 327, 328, and 332, according to the EU index. Exemplary substitutions for enhancing FcγRIIb affinity include but are not limited to 234D, 234E, 234F, 234W, 235D, 235F, 235R, 235Y, 236D, 236N, 237D, 237N, 239D, 239E, 266M, 267D, 267E, 268D, 268E, 327D, 327E, 328F, 328W, 328Y, and 332E. Exemplary substitutions include 235Y, 236D, 239D, 266M, 267E, 268D, 268E, 328F, 328W, and 328Y. Other Fc variants for enhancing binding to FcγRIIb include 235Y/267E, 236D/267E, 239D/268D, 239D/267E, 267E/268D, 267E/268E, and 267E/328F.

The affinities and binding properties of an Fc region for its ligand may be determined by a variety of in vitro assay methods (biochemical or immunological based assays) known in the art including but not limited to, equilibrium methods (e.g., ELISA, or radioimmunoassay), or kinetics (e.g., BIACORE analysis), and other methods such as indirect binding assays, competitive inhibition assays, fluorescence resonance energy transfer (FRET), gel electrophoresis and chromatography (e.g., gel filtration). These and other methods may utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental Immunology, 4th Ed., Lippincott-Raven, Philadelphia (1999), which focuses on antibody-immunogen interactions.

In some embodiments, the antibody is modified to increase its biological half-life. Various approaches are possible. For example, this may be done by increasing the binding affinity of the Fc region for FcRn. For example, one or more of the following residues can be mutated: 252, 254, 256, 433, 435, 436, as described in U.S. Pat. No. 6,277,375. Specific exemplary substitutions include one or more of the following: T252L, T254S, and/or T256F. Alternatively, to increase the biological half-life, the antibody can be altered within the CH1 or $C_L$ region to contain a salvage receptor binding epitope taken from two loops of a CH2 domain of an Fc region of an IgG, as described in U.S. Pat. Nos. 5,869,046 and 6,121,022 by Presta et al. Other exemplary variants that increase binding to FcRn and/or improve pharmacokinetic properties include substitutions at positions 259, 308, 428, and 434, including for example 259I, 308F, 428L, 428M, 434S, 434H, 434F, 434Y, and 434M. Other variants that increase Fc binding to FcRn include: 250E, 250Q, 428L, 428F, 250Q/428L (Hinton et al, 2004, J. Biol. Chem. 279(8): 6213-6216, Hinton et al. 2006 Journal of Immunology 176:346-356), 256A, 272A, 286A, 305A, 307A, 307Q, 311A, 312A, 376A, 378Q, 380A, 382A, 434A (Shields et al, Journal of Biological Chemistry, 2001, 276 (9):6591-6604), 252F, 252T, 252Y, 252W, 254T, 256S, 256R, 256Q, 256E, 256D, 256T, 309P, 311S, 433R, 433S, 433I, 433P, 433Q, 434H, 434F, 434Y, 252Y/254T/256E, 433K/434F/436H, 308T/309P/311S (Dall Acqua et al. Journal of Immunology, 2002, 169:5171-5180, Dall'Acqua et al., 2006, Journal of Biological Chemistry 281:23514-23524). Other modifications for modulating FcRn binding are described in Yeung et al., 2010, J Immunol, 182:7663-7671. In some embodiments, hybrid IgG isotypes with particular biological characteristics may be used. For example, an IgG1/IgG3 hybrid variant may be constructed by substituting IgG 1 positions in the CH2 and/or CH3 region with the amino acids from IgG3 at positions where the two isotypes differ. Thus a hybrid variant IgG antibody may be constructed that comprises one or more substitutions, e.g., 274Q, 276K, 300F, 339T, 356E, 358M, 384S, 392N, 397M, 422I, 435R, and 436F. In other embodiments described herein, an IgG1/IgG2 hybrid variant may be constructed by substituting IgG2 positions in the CH2 and/or CH3 region with amino acids from IgG1 at positions where the two isotypes differ. Thus a hybrid variant IgG antibody may be constructed chat comprises one or more substitutions, e.g., one or more of the following amino acid substitutions: 233E, 234L, 235L, 236G (referring to an insertion of a glycine at position 236), and 321 h.

Moreover, the binding sites on human IgG1 for FcγRI, FcγRII, FcγRIII, and FcRn have been mapped and variants with improved binding have been described (see Shields, R. L. et al. (2001) J. Biol. Chem. 276:6591-6604). Specific mutations at positions 256, 290, 298, 333, 334, and 339 were shown to improve binding to FcγRIII. Additionally, the following combination mutants were shown to improve FcγRIII binding: T256A/S298A, S298A/E333A, S298A/K224A, and S298A/E333A/K334A, which has been shown to exhibit enhanced FcγRIIIa binding and ADCC activity (Shields et al., 2001). Other IgG1 variants with strongly enhanced binding to FcγRIIIa have been identified, including variants with S239D/I332E and S239D/I332E/A330L mutations which showed the greatest increase in affinity for FcγRIIIa, a decrease in FcγRIIb binding, and strong cytotoxic activity in cynomolgus monkeys (Lazar et al., 2006). Introduction of the triple mutations into antibodies such as alemtuzumab (CD52-specific), trastuzumab (HER2/neu-specific), rituximab (CD20-specific), and cetuximab (EGFR-specific) translated into greatly enhanced ADCC activity in vitro, and the S239D/I332E variant showed an enhanced capacity to deplete B cells in monkeys (Lazar et al., 2006). In addition, IgG1 mutants containing L235V, F243L, R292P, Y300L and P396L mutations which exhibited enhanced binding to FcγRIIIa and concomitantly enhanced ADCC activity in transgenic mice expressing human FcγRIIIa in models of B cell malignancies and breast cancer have been identified (Stavenhagen et al., 2007; Nordstrom et al., 2011). Other Fc mutants that may be used include: S298A/E333A/L334A, S239D/I332E, S239D/I332E/A330L, L235V/F243L/R292P/Y300L/P396L, and M428L/N434S.

In some embodiments, an Fc is chosen that has reduced binding to FcγRs. An exemplary Fc, e.g., IgG1 Fc, with reduced FcγR binding, comprises the following three amino acid substitutions: L234A, L235E, and G237A.

In some embodiments, an Fc is chosen that has reduced complement fixation. An exemplary Fc, e.g., IgG1 Fc, with reduced complement fixation, has the following two amino acid substitutions: A330S and P331S.

In some embodiments, an Fc is chosen that has essentially no effector function, i.e., it has reduced binding to FcγRs and reduced complement fixation. An exemplary Fc, e.g., IgG1 Fc, that is effectorless, comprises the following five mutations: L234A, L235E, G237A, A330S, and P331S.

When using an IgG4 constant domain, it is usually preferable to include the substitution S228P, which mimics the hinge sequence in IgG1 and thereby stabilizes IgG4 molecules.

Multivalent Antibodies

In one embodiment, the antibodies of the invention may be monovalent or multivalent (e.g., bivalent, trivalent, etc.). As used herein, the term "valency" refers to the number of potential target binding sites associated with an antibody. Each target binding site specifically binds one target molecule or specific position or locus on a target molecule. When an antibody is monovalent, each binding site of the molecule will specifically bind to a single antigen position or epitope. When an antibody comprises more than one target binding site (multivalent), each target binding site may specifically bind the same or different molecules (e.g., may bind to different ligands or different antigens, or different epitopes or positions on the same antigen). See, for example, U.S.P.N. 2009/0130105. In each case, at least one of the binding sites will comprise an epitope, motif or domain associated with a DLL3 isoform.

In one embodiment, the antibodies are bispecific antibodies in which the two chains have different specificities, as described in Millstein et al., 1983, Nature, 305:537-539. Other embodiments include antibodies with additional specificities, such as trispecific antibodies. Other more sophisticated compatible multispecific constructs and methods of their fabrication are set forth in U.S.P.N. 2009/0155255, as well as WO 94/04690; Suresh et al., 1986, Methods in Enzymology, 121:210; and WO96/27011.

As stated above, multivalent antibodies may immunospecifically bind to different epitopes of the desired target molecule or may immunospecifically bind to both the target molecule as well as a heterologous epitope, such as a heterologous polypeptide or solid support material. In some embodiments, the multivalent antibodies may include bispecific antibodies or trispecific antibodies. Bispecific antibodies also include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980), and for treatment of HIV infection (WO 91/00360, WO 92/200373, and EP 03089). Heteroconjugate antibodies may be made using any convenient cross-linking methods. Suitable cross-linking agents are well known in the art and are disclosed in U.S. Pat. No. 4,676,980, along with a number of cross-linking techniques.

In some embodiments, antibody variable domains with the desired binding specificities (antibody-antigen combining sites) are fused to immunoglobulin constant domain sequences, such as an immunoglobulin heavy chain constant domain comprising at least part of the hinge, CH2, and/or CH3 regions, using methods well known to those of ordinary skill in the art.

Antibody Derivatives

An antibody provided herein may be further modified to contain additional nonproteinaceous moieties that are known in the art and readily available. The moieties suitable for derivatization of the antibody include but are not limited to water-soluble polymers.

Non-limiting examples of water-soluble polymers include, but are not limited to, PEG, copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, polypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In another embodiment, conjugates of an antibody and nonproteinaceous moiety that may be selectively heated by exposure to radiation are provided. In one embodiment, the nonproteinaceous moiety is a carbon nanotube (Kam et al., Proc. Natl. Acad. Sci. USA 102: 11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

Another modification of the antibodies described herein is pegylation. An antibody can be pegylated to, for example, increase the biological (e.g., serum) half-life of the antibody. To pegylate an antibody, the antibody, or fragment thereof, typically is reacted with PEG, such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (CI-CIO) alkoxy- or aryloxy-polyethylene glycol or polyethylene glycol-maleimide. In some embodiments, the antibody to be pegylated is an aglycosylated antibody. Methods for pegylating proteins are known in the art and can be applied to the antibodies described herein. See, for example, EP 0 154 316 by Nishimura et al. and EP0401384 by Ishikawa et al.

The present invention also encompasses a human monoclonal antibody described herein conjugated to a therapeutic agent, a polymer, a detectable label or enzyme. In one embodiment, the therapeutic agent is a cytotoxic agent. In one embodiment, the polymer is PEG.

Nucleic Acids, Expression Cassettes, and Vectors

The present invention provides isolated nucleic acid segments that encode the polypeptides, peptide fragments, and coupled proteins of the invention. The nucleic acid segments of the invention also include segments that encode for the same amino acids due to the degeneracy of the genetic code. For example, the amino acid threonine is encoded by ACU, ACC, ACA, and ACG and is therefore degenerate. It is intended that the invention includes all variations of the polynucleotide segments that encode for the same amino acids. Such mutations are known in the art (Watson et al., Molecular Biology of the Gene, Benjamin Cummings 1987). Mutations also include alteration of a nucleic acid segment to encode for conservative amino acid changes, for example, the substitution of leucine for isoleucine and so forth. Such mutations are also known in the art. Thus, the genes and nucleotide sequences of the invention include both the naturally occurring sequences as well as mutant forms.

The nucleic acid segments of the invention may be contained within a vector. A vector may include, but is not limited to, any plasmid, phagemid, F-factor, virus, cosmid, or phage in a double- or single-stranded linear or circular form which may or may not be self transmissible or mobilizable. The vector can also transform a prokaryotic or eukaryotic host either by integration into the cellular genome or exist extra-chromosomally (e.g., autonomous replicating plasmid with an origin of replication).

Preferably the nucleic acid segment in the vector is under the control of, and operably linked to, an appropriate promoter or other regulatory elements for transcription in vitro or in a host cell, such as a eukaryotic cell, or a microbe, e.g., bacteria. The vector may be a shuttle vector that functions in multiple hosts. The vector may also be a cloning vector that typically contains one or a small number of restriction endonuclease recognition sites at which foreign DNA sequences can be inserted in a determinable fashion. Such insertion can occur without loss of essential biological function of the cloning vector. A cloning vector may also contain a marker gene that is suitable for use in the identification and selection of cells transformed with the cloning vector. Examples of marker genes are tetracycline resistance or ampicillin resistance. Many cloning vectors are commercially available (Stratagene, New England Biolabs, Clonetech).

The nucleic acid segments of the invention may also be inserted into an expression vector. Typically an expression vector contains prokaryotic DNA elements coding for a bacterial replication origin and an antibiotic resistance gene to provide for the amplification and selection of the expression vector in a bacterial host; regulatory elements that control initiation of transcription such as a promoter; and DNA elements that control the processing of transcripts such as introns, or a transcription termination/polyadenylation sequence.

Methods to introduce nucleic acid segment into a vector are available in the art (Sambrook et al., Molecular Cloning: A Laboratory Manual, 3rd edition, Cold Spring Harbor Press, Cold Spring Harbor, N.Y. (2001)). Briefly, a vector into which a nucleic acid segment is to be inserted is treated with one or more restriction enzymes (restriction endonuclease) to produce a linearized vector having a blunt end, a "sticky" end with a 5' or a 3' overhang, or any combination of the above. The vector may also be treated with a restriction enzyme and subsequently treated with another modifying enzyme, such as a polymerase, an exonuclease, a phosphatase or a kinase, to create a linearized vector that has characteristics useful for ligation of a nucleic acid segment into the vector. The nucleic acid segment that is to be inserted into the vector is treated with one or more restriction enzymes to create a linearized segment having a blunt end, a "sticky" end with a 5' or a 3' overhang, or any combination of the above. The nucleic acid segment may also be treated with a restriction enzyme and subsequently treated with another DNA modifying enzyme. Such DNA modifying enzymes include, but are not limited to, polymerase, exonuclease, phosphatase or a kinase, to create a nucleic acid segment that has characteristics useful for ligation of a nucleic acid segment into the vector.

The treated vector and nucleic acid segment are then ligated together to form a construct containing a nucleic acid segment according to methods available in the art (Sambrook et al., Molecular Cloning: A Laboratory Manual, 3rd edition, Cold Spring Harbor Press, Cold Spring Harbor, N.Y. (2001)). Briefly, the treated nucleic acid fragment, and the treated vector are combined in the presence of a suitable buffer and ligase. The mixture is then incubated under appropriate conditions to allow the ligase to ligate the nucleic acid fragment into the vector.

The invention also provides an expression cassette which contains a nucleic acid sequence capable of directing expression of a particular nucleic acid segment of the invention, either in vitro or in a host cell. Also, a nucleic acid segment of the invention may be inserted into the expression cassette such that an anti-sense message is produced. The expression cassette is an isolatable unit such that the expression cassette may be in linear form and functional for in vitro transcription and translation assays. The materials and procedures to conduct these assays are commercially available from Promega Corp. (Madison, Wis.). For example, an in vitro transcript may be produced by placing a nucleic acid sequence under the control of a T7 promoter and then using T7 RNA polymerase to produce an in vitro transcript. This transcript may then be translated in vitro through use of a rabbit reticulocyte lysate. Alternatively, the expression cassette can be incorporated into a vector allowing for replication and amplification of the expression cassette within a host cell or also in vitro transcription and translation of a nucleic acid segment.

Such an expression cassette may contain one or a plurality of restriction sites allowing for placement of the nucleic acid segment under the regulation of a regulatory sequence. The expression cassette can also contain a termination signal operably linked to the nucleic acid segment as well as regulatory sequences required for proper translation of the nucleic acid segment. The expression cassette containing the nucleic acid segment may be chimeric, meaning that at least one of its components is heterologous with respect to at least one of its other components. The expression cassette may also be one that is naturally occurring but has been obtained in a recombinant form useful for heterologous expression. Expression of the nucleic acid segment in the expression cassette may be under the control of a constitutive promoter or an inducible promoter, which initiates transcription only when the host cell is exposed to some particular external stimulus.

The expression cassette may include in the 5'-3' direction of transcription, a transcriptional and translational initiation region, a nucleic acid segment and a transcriptional and translational termination region functional in vivo and/or in vitro. The termination region may be native with the transcriptional initiation region, may be native with the nucleic acid segment, or may be derived from another source.

The regulatory sequence can be a polynucleotide sequence located upstream (5' non-coding sequences), within, or downstream (3' non-coding sequences) of a coding sequence, and which influences the transcription, RNA processing or stability, or translation of the associated coding sequence. Regulatory sequences can include, but are not limited to, enhancers, promoters, repressor binding sites, translation leader sequences, introns, and polyadenylation signal sequences. They may include natural and synthetic sequences as well as sequences, which may be a combination of synthetic and natural sequences. While regulatory sequences are not limited to promoters, some useful regulatory sequences include constitutive promoters, inducible promoters, regulated promoters, tissue-specific promoters, viral promoters, and synthetic promoters.

A promoter is a nucleotide sequence that controls the expression of the coding sequence by providing the recognition for RNA polymerase and other factors required for proper transcription. A promoter includes a minimal promoter, consisting only of all basal elements needed for transcription initiation, such as a TATA-box and/or initiator that is a short DNA sequence comprised of a TATA-box and other sequences that serve to specify the site of transcription initiation, to which regulatory elements are added for control of expression. A promoter may be derived entirely from a native gene, or be composed of different elements derived from different promoters found in nature, or even be comprised of synthetic DNA segments. A promoter may contain DNA sequences that are involved in the binding of protein factors that control the effectiveness of transcription initiation in response to physiological or developmental conditions.

The invention also provides a construct containing a vector and an expression cassette. The vector may be selected from, but not limited to, any vector previously described. Into this vector may be inserted an expression cassette through methods known in the art and previously described (Sambrook et al., Molecular Cloning: A Laboratory Manual, 3rd edition, Cold Spring Harbor Press, Cold Spring Harbor, N.Y. (2001)). In one embodiment, the regulatory sequences of the expression cassette may be derived from a source other than the vector into which the expression cassette is inserted. In another embodiment, a construct containing a vector and an expression cassette is formed upon insertion of a nucleic acid segment of the invention into a vector that itself contains regulatory sequences. Thus, an expression cassette is formed upon insertion of the nucleic acid segment into the vector. Vectors containing regulatory sequences are available commercially, and methods for their use are known in the art (Clonetech, Promega, Stratagene).

In another aspect, this disclosure also provides (i) a nucleic acid molecule encoding a polypeptide chain of the antibody or antigen-binding fragment thereof described above; (ii) a vector comprising the nucleic acid molecule as described; and (iii) a cultured host cell comprising the vector as described. Also provided is a method for producing a polypeptide, comprising: (a) obtaining the cultured host cell as described; (b) culturing the cultured host cell in a medium under conditions permitting expression of a polypeptide encoded by the vector and assembling of an antibody or fragment thereof; and (c) purifying the antibody or fragment from the cultured cell or the medium of the cell.

Methods of Production

Antibodies may be produced using recombinant methods and compositions, e.g., as described in U.S. Pat. No. 4,816,567. In one embodiment, an isolated nucleic acid encoding an antibody described herein is provided. Such nucleic acid may encode an amino acid sequence comprising the VL and/or an amino acid sequence comprising the VH of the antibody (e.g., the light and/or heavy chains of the antibody). In a further embodiment, one or more vectors (e.g., expression vectors) comprising such nucleic acid are provided. In a further embodiment, a host cell comprising such nucleic acid is provided. In one such embodiment, a host cell comprises (e.g., has been transformed with): (1) a vector comprising a nucleic acid that encodes an amino acid sequence comprising the VL of the antibody and an amino acid sequence comprising the VH of the antibody, or (2) a first vector comprising a nucleic acid that encodes an amino acid sequence comprising the VL of the antibody and a second vector comprising a nucleic acid that encodes an amino acid sequence comprising the VH of the antibody. In one embodiment, the host cell is eukaryotic, e.g., a Chinese Hamster Ovary (CHO) cell or lymphoid cell (e.g., Y0, NS0, Sp20 cell). In one embodiment, a method of making an antibody is provided, wherein the method comprises culturing a host cell comprising a nucleic acid encoding the antibody, as provided above, under conditions suitable for expression of the antibody, and optionally recovering the antibody from the host cell (or host cell culture medium).

For recombinant production of an antibody, a nucleic acid encoding an antibody, e.g., as described above, is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the heavy and light chains of the antibody).

Suitable host cells for cloning or expression of antibody-encoding vectors include prokaryotic or eukaryotic cells described herein. For example, antibodies may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523. (See also Charlton, Methods in Molecular Biology, Vol. 248 (B. K. C. Lo, ed., Humana Press, Totowa, N.J., 2003), pp. 245-254, describing expression of antibody fragments in *E. coli.*) After expression, the antibody may be isolated from the bacterial cell paste in a soluble fraction and can be further purified.

In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern. See Gerngross, Nat. Biotech. 22:1409-1414 (2004), and Li et al., Nat. Biotech. 24:210-215 (2006).

Suitable host cells for the expression of glycosylated antibody are also derived from multicellular organisms (invertebrates and vertebrates). Examples of invertebrate cells include plant and insect cells. Numerous baculoviral strains have been identified, which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429 (describing PLANTIBODIES technology for producing antibodies in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., J. Gen Virol. 36:59 (1977)); baby hamster kidney cells (BHK); mouse sertoli cells (TM4 cells as described, e.g., in Mather, Biol. Reprod. 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., Annals N.Y. Acad. Sci. 383:44-68 (1982); MRC 5 cells; and FS4 cells. Other useful mammalian host cell lines include CHO cells, including DHFR-CHO cells (Urlaub et al., Proc. Natl. Acad. Sci. USA 77:4216 (1980)); and myeloma cell lines such as Y0, NS0, and Sp2/0. For a review of certain mammalian host cell lines suitable for antibody production, see, e.g., Yazaki and Wu, Methods in Molecular Biology, Vol. 248 (B. K. C. Lo, ed., Humana Press, Totowa, N.J.), pp. 255-268 (2003).

Compositions and Kits

The antibodies of this invention represent an excellent way for the development of antiviral therapies either alone or in antibody cocktails with additional anti-SARS-CoV-2 virus antibodies for the treatment of human SARS-CoV-2 infections in humans.

In another aspect, the present invention provides a pharmaceutical composition comprising the antibodies of the present invention described herein formulated together with a pharmaceutically acceptable carrier. The composition may optionally contain one or more additional pharmaceutically active ingredients, such as another antibody or a therapeutic agent.

In some embodiments, the pharmaceutical comprises two or more of the antibody or antigen-binding fragment thereof described above, such as any combinations of the antibody or antigen-binding fragment thereof comprising a heavy chain and a light chain that comprise the respective amino acid sequences described herein.

The pharmaceutical compositions of the invention also can be administered in a combination therapy with, for example, another immune-stimulatory agent, an antiviral agent, or a vaccine, etc. In some embodiments, a composition comprises an antibody of this invention at a concentration of at least 1 mg/ml, 5 mg/ml, 10 mg/ml, 50 mg/ml, 100 mg/ml, 150 mg/ml, 200 mg/ml, 1-300 mg/ml, or 100-300 mg/ml.

In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine or an interferon. In some embodiments, the interferon is an interferon-α or an interferon-β.

Also within the scope of this disclosure is use of the pharmaceutical composition in the preparation of a medicament for the diagnosis, prophylaxis, treatment, or combination thereof of a condition resulting from a SARS-CoV-2.

The pharmaceutical composition can comprise any number of excipients. Excipients that can be used include carriers, surface-active agents, thickening or emulsifying agents, solid binders, dispersion or suspension aids, solubilizers, colorants, flavoring agents, coatings, disintegrating agents, lubricants, sweeteners, preservatives, isotonic agents, and combinations thereof. The selection and use of suitable excipients is taught in Gennaro, ed., Remington: The Science and Practice of Pharmacy, 20th Ed. (Lippincott Williams & Wilkins 2003), the disclosure of which is incorporated herein by reference.

Preferably, a pharmaceutical composition is suitable for intravenous, intramuscular, subcutaneous, parenteral, spinal or epidermal administration (e.g., by injection or infusion). Depending on the route of administration, the active compound can be coated in a material to protect it from the action of acids and other natural conditions that may inactivate it. The phrase "parenteral administration" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion. Alternatively, an antibody of the present invention described herein can be administered via a non-parenteral route, such as a topical, epidermal or mucosal route of administration, e.g., intranasally, orally, vaginally, rectally, sublingually or topically.

The pharmaceutical compositions of the invention may be prepared in many forms that include tablets, hard or soft gelatin capsules, aqueous solutions, suspensions, and liposomes and other slow-release formulations, such as shaped polymeric gels. An oral dosage form may be formulated such that the antibody is released into the intestine after passing through the stomach. Such formulations are described in U.S. Pat. No. 6,306,434 and in the references contained therein.

Oral liquid pharmaceutical compositions may be in the form of, for example, aqueous or oily suspensions, solutions, emulsions, syrups or elixirs, or may be presented as a dry product for constitution with water or other suitable vehicle before use. Such liquid pharmaceutical compositions may contain conventional additives such as suspending agents, emulsifying agents, non-aqueous vehicles (which may include edible oils), or preservatives.

An antibody can be formulated for parenteral administration (e.g., by injection, for example, bolus injection or continuous infusion) and may be presented in unit dosage form in ampules, prefilled syringes, small volume infusion containers or multi-dose containers with an added preservative. The pharmaceutical compositions may take such forms as suspensions, solutions, or emulsions in oily or aqueous vehicles, and may contain formulatory agents such as suspending, stabilizing and/or dispersing agents. Pharmaceutical compositions suitable for rectal administration can be prepared as unit dose suppositories. Suitable carriers include saline solution and other materials commonly used in the art.

For administration by inhalation, an antibody can be conveniently delivered from an insufflator, nebulizer or a pressurized pack or other convenient means of delivering an aerosol spray. Pressurized packs may comprise a suitable propellant such as dichlorodifluoromethane, trichlorofluoromethane, dichlorotetrafluoroethane, carbon dioxide or other suitable gas. In the case of a pressurized aerosol, the dosage unit may be determined by providing a valve to deliver a metered amount.

Alternatively, for administration by inhalation or insufflation, an antibody may take the form of a dry powder composition, for example, a powder mix of a modulator and a suitable powder base such as lactose or starch. The powder composition may be presented in unit dosage form in, for example, capsules or cartridges or, e.g., gelatin or blister packs from which the powder may be administered with the aid of an inhalator or insufflator. For intra-nasal administration, an antibody may be administered via a liquid spray, such as via a plastic bottle atomizer.

Pharmaceutical compositions of the invention may also contain other ingredients such as flavorings, colorings, antimicrobial agents, or preservatives. It will be appreciated that the amount of an antibody required for use in treatment will vary not only with the particular carrier selected but also with the route of administration, the nature of the condition being treated and the age and condition of the patient. Ultimately the attendant health care provider may determine proper dosage. In addition, a pharmaceutical composition may be formulated as a single unit dosage form.

The pharmaceutical composition of the present invention can be in the form of sterile aqueous solutions or dispersions. It can also be formulated in a microemulsion, liposome, or other ordered structure suitable to high drug concentration.

An antibody of the present invention described herein can be administered as a sustained release formulation, in which case less frequent administration is required. Dosage and frequency vary depending on the half-life of the antibody in the patient. In general, human antibodies show the longest half-life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, and preferably, until the patient shows partial or complete amelioration of symptoms of disease. Thereafter, the patient can be administered a prophylactic regime.

The amount of active ingredient that can be combined with a carrier material to produce a single dosage form will vary depending upon the subject being treated and the particular mode of administration and will generally be that amount of the composition, which produces a therapeutic effect. Generally, out of one hundred percent, this amount will range from about 0.01% to about 99% of active ingredient, preferably from about 0.1% to about 70%, most preferably from about 1% to about 30% of active ingredient in combination with a pharmaceutically acceptable carrier.

Dosage regimens can be adjusted to provide the optimum desired response (e.g., a therapeutic response). For example, a single bolus can be administered, several divided doses can be administered over time or the dose can be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. Alternatively, the antibody can be administered as a sustained release formulation, in which case less frequent administration is required. For administration of the antibody, the dosage ranges from about 0.0001 to 800 mg/kg, and more usually 0.01 to 5 mg/kg, of the host body weight. For example dosages can be 0.3 mg/kg body weight, 1 mg/kg body weight, 3 mg/kg body weight, 5 mg/kg body weight or 10 mg/kg body weight or within the range of 1-10 mg/kg. An exemplary treatment regime entails administration once per week, once every two weeks, once every three weeks, once every four weeks, once a month, once every 3 months or once every three to 6 months. Preferred dosage regimens for an antibody of the invention include 1 mg/kg body weight or 3 mg/kg body weight via intravenous administration, with the antibody being given using one of the following dosing schedules: (i) every four weeks for six dosages, then every three months; (ii) every three weeks; (iii) 3 mg/kg body weight once followed by 1 mg/kg body weight every three weeks. In some methods, dosage is adjusted to achieve a plasma antibody concentration of about 1-1000 µg/ml and in some methods about 25-300 µg/ml. A "therapeutically effective dosage" of an antibody of the invention preferably results in a decrease in severity of disease symptoms, an increase in frequency and duration of disease symptom-free periods, or a prevention of impairment or disability due to the disease affliction. For example, for the treatment of SARS-CoV-2 infection in a subject, a "therapeutically effective dosage" preferably inhibits SARS-CoV-2 virus replication or uptake by host cells by at least about 20%, more preferably by at least about 40%, even more preferably by at least about 60%, and still more preferably by at least about 80% relative to untreated subjects. A therapeutically effective amount of a therapeutic compound can neutralize SARS-CoV-2 virus, or otherwise ameliorate symptoms in a subject, which is typically a human or can be another mammal.

The pharmaceutical composition can be a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. See, e.g., Sustained and Controlled Release Drug Delivery Systems, J. R. Robinson, ed., Marcel Dekker, Inc., New York, 1978.

Therapeutic compositions can be administered via medical devices such as (1) needleless hypodermic injection devices (e.g., U.S. Pat. Nos. 5,399,163; 5,383,851; 5,312,335; 5,064,413; 4,941,880; 4,790,824; and 4,596,556); (2) micro-infusion pumps (U.S. Pat. No. 4,487,603); (3) transdermal devices (U.S. Pat. No. 4,486,194); (4) infusion apparati (U.S. Pat. Nos. 4,447,233 and 4,447,224); and (5) osmotic devices (U.S. Pat. Nos. 4,439,196 and 4,475,196); the disclosures of which are incorporated herein by reference.

In some embodiments, the human monoclonal antibodies of the invention described herein can be formulated to ensure proper distribution in vivo. For example, to ensure that the therapeutic compounds of the invention cross the blood-brain barrier, they can be formulated in liposomes, which may additionally comprise targeting moieties to enhance selective transport to specific cells or organs. See, e.g., U.S. Pat. Nos. 4,522,811; 5,374,548; 5,416,016; and 5,399,331; V. V. Ranade (1989) Clin. Pharmacol. 29:685; Umezawa et al., (1988) Biochem. Biophys. Res. Commun. 153:1038; Bloeman et al. (1995) FEBS Lett. 357:140; M. Owais et al. (1995) Antimicrob. Agents Chemother. 39:180; Briscoe et al. (1995) Am. Physiol. 1233:134; Schreier et al. (1994). Biol. Chem. 269:9090; Keinanen and Laukkanen (1994) FEBS Lett. 346:123; and Killion and Fidler (1994) Immunomethods 4:273.

In some embodiments, the initial dose may be followed by administration of a second or a plurality of subsequent doses of the antibody or antigen-binding fragment thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

Various delivery systems are known and can be used to administer the pharmaceutical composition of the invention, e.g., encapsulation in liposomes, microparticles, microcapsules, recombinant cells capable of expressing the mutant viruses, receptor-mediated endocytosis (see, e.g., Wu et al. (1987) J. Biol. Chem. 262:4429-4432). Methods of introduction include, but are not limited to, intradermal, transdermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. The pharmaceutical composition can also be delivered in a vesicle, in particular, a liposome (see, for example, Langer (1990) Science 249: 1527-1533).

The use of nanoparticles to deliver the antibodies of the present invention is also contemplated herein. Antibody-conjugated nanoparticles may be used both for therapeutic and diagnostic applications. Antibody-conjugated nanoparticles and methods of preparation and use are described in detail by Arruebo, M., et al. 2009 ("Antibody-conjugated nanoparticles for biomedical applications" in J. Nanomat. Volume 2009, Article ID 439389), incorporated herein by reference. Nanoparticles may be developed and conjugated to antibodies contained in pharmaceutical compositions to target cells. Nanoparticles for drug delivery have also been described in, for example, U.S. Pat. No. 8,257,740, or U.S. Pat. No. 8,246,995, each incorporated herein in its entirety.

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous, intracranial, intraperitoneal and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, IN), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, NJ), OPTIPEN™, OPTIPEN PRO™, OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly), the SURECLICK™ Autoinjector (Amgen, Thousand Oaks, CA), the PENLET™ (Haselmeier, Stuttgart, Germany), the EPIPEN (Dey, L. P.) and the HUMIRA™ Pen (Abbott Labs, Abbott Park, IL), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the antibody contained is generally about 5 to about 500 mg per dosage form in a unit dose; especially in the form of injection, it is preferred that the antibody is contained in about 5 to about 300 mg and in about 10 to about 300 mg for the other dosage forms.

In another aspect, this disclosure provides a kit comprising a pharmaceutically acceptable dose unit of the antibody or antigen-binding fragment thereof or of the pharmaceutical composition as described above. Also within the scope of this disclosure is a kit for the diagnosis, prognosis or monitoring of treatment of SARS-CoV-2 in a subject, comprising: the antibody or antigen-binding fragment thereof as described; and a least one detection reagent that binds specifically to the antibody or antigen-binding fragment thereof.

In some embodiments, the kit also includes a container that contains the composition and optionally informational material. The informational material can be descriptive, instructional, marketing or other material that relates to the methods described herein and/or the use of the agents for therapeutic benefit. In an embodiment, the kit also includes an additional therapeutic agent, as described above. For example, the kit includes a first container that contains the composition and a second container for the additional therapeutic agent.

The informational material of the kits is not limited in its form. In some embodiments, the informational material can include information about production of the composition, concentration, date of expiration, batch or production site information, and so forth. In one embodiment, the informational material relates to methods of administering the composition, e.g., in a suitable dose, dosage form, or mode of administration (e.g., a dose, dosage form, or mode of administration described herein), to treat a subject in need thereof. In one embodiment, the instructions provide a dosing regimen, dosing schedule, and/or route of administration of the composition or the additional therapeutic agent. The information can be provided in a variety of formats, including printed text, computer-readable material, video recording, or audio recording, or information that contains a link or address to substantive material.

The kit can include one or more containers for the composition. In some embodiments, the kit contains separate containers, dividers, or compartments for the composition and informational material. For example, the composition can be contained in a bottle or vial, and the informational material can be contained in a plastic sleeve or packet. In other embodiments, the separate elements of the kit are contained within a single, undivided container. For example, the composition is contained in a bottle or vial that has attached thereto the informational material in the form of a label. In some embodiments, the kit includes a plurality (e.g., a pack) of individual containers, each containing one or more unit dosage forms (e.g., a dosage form described herein) of the agents.

The kit optionally includes a device suitable for administration of the composition or other suitable delivery device. The device can be provided pre-loaded with one or both of the agents or can be empty, but suitable for loading. Such a kit may optionally contain a syringe to allow for injection of the antibody contained within the kit into an animal, such as a human.

Methods of Use
Methods of Treatment

The antibodies, compositions, and formulations described herein can be used to neutralize SARS-CoV-2 virus and thereby treating or preventing SARS-CoV-2 infections.

Accordingly, in one aspect, this disclosure further provides a method of neutralizing SARS-CoV-2 in a subject, comprising administering to a subject in need thereof a therapeutically effective amount of the antibody or antigen-binding fragment thereof or a therapeutically effective amount of the pharmaceutical composition, as described above.

In another aspect, this disclosure additionally provides a method of preventing or treating a SARS-CoV-2 infection, comprising administering to a subject in need thereof a therapeutically effective amount of the antibody or antigen-binding fragment thereof or a therapeutically effective amount of the pharmaceutical composition, as described above.

The neutralizing of the SARS-CoV-2 virus can be done via (i) inhibiting SARS-CoV-2 virus binding to a target cell; (ii) inhibiting SARS-CoV-2 virus uptake by a target cell; (iii) inhibiting SARS-CoV-2 virus replication; and (iv) inhibiting SARS-CoV-2 virus particles release from infected cells. One skilled in the art possesses the ability to perform any assay to assess neutralization of SARS-CoV-2 virus.

Notably, the neutralizing properties of antibodies may be assessed by a variety of tests, which all may assess the consequences of (i) inhibition of SARS-CoV-2 virus binding to a target cell; (ii) inhibition of SARS-CoV-2 virus uptake by a target cell; (iii) inhibition of SARS-CoV-2 virus replication; and (iv) inhibition of SARS-CoV-2 virus particles release from infected cells. In other words, implementing different tests may lead to the observation of the same consequence, i.e., the loss of infectivity of the SARS-CoV-2 virus. Thus, in one embodiment, the present invention provides a method of neutralizing SARS-CoV-2 virus in a subject comprising administering to the subject a therapeutically effective amount of the antibody of the present invention described herein.

Another aspect of the present invention provides a method of treating a SARS-CoV-2-related disease. Such a method includes therapeutic (following SARS-CoV-2 infection) and prophylactic (prior to SARS-CoV-2 exposure, infection, or pathology). For example, therapeutic and prophylactic methods of treating an individual for a SARS-CoV-2 infection include treatment of an individual having or at risk of having a SARS-CoV-2 infection or pathology, treating an individual with a SARS-CoV-2 infection, and methods of protecting an individual from a SARS-CoV-2 infection, to decrease or reduce the probability of a SARS-CoV-2 infection in an individual, to decrease or reduce susceptibility of an individual to a SARS-CoV-2 infection, or to inhibit or prevent a SARS-CoV-2 infection in an individual, and to decrease, reduce, inhibit or suppress transmission of a SARS-CoV-2 from an infected individual to an uninfected individual. Such methods include administering an antibody of the present invention or a composition comprising the antibody disclosed herein to therapeutically or prophylactically treat (vaccinate or immunize) an individual having or at risk of having a SARS-CoV-2 infection or pathology. Accordingly, methods can treat the SARS-CoV-2 infection or pathology, or provide the individual with protection from infection (e.g., prophylactic protection).

In one embodiment, a method of treating a SARS-CoV-2-related disease comprises administering to an individual in need thereof an antibody or therapeutic composition disclosed herein in an amount sufficient to reduce one or more physiological conditions or symptoms associated with a SARS-CoV-2 infection or pathology, thereby treating the SARS-CoV-2-related disease.

In one embodiment, an antibody or therapeutic composition disclosed herein is used to treat a SARS-CoV-2-related disease. Use of an antibody or therapeutic composition disclosed herein treats a SARS-CoV-2-related disease by reducing one or more physiological conditions or symptoms associated with a SARS-CoV-2 infection or pathology. In aspects of this embodiment, administration of an antibody or therapeutic composition disclosed herein is in an amount sufficient to reduce one or more physiological conditions or symptoms associated with a SARS-CoV-2 infection or pathology, thereby treating the SARS-CoV-2-based disease. In other aspects of this embodiment, administration of an antibody or therapeutic composition disclosed herein is in an amount sufficient to increase, induce, enhance, augment, promote or stimulate SARS-CoV-2 clearance or removal; or decrease, reduce, inhibit, suppress, prevent, control, or limit transmission of SARS-CoV-2 to another individual.

One or more physiological conditions or symptoms associated with a SARS-CoV-2 infection or pathology will respond to a method of treatment disclosed herein. The symptoms of SARS-CoV-2 infection or pathology vary, depending on the phase of infection.

In some embodiments, the method of neutralizing SARS-CoV-2 in a subject comprises administering to a subject in need thereof a therapeutically effective amount of a first antibody or antigen-binding fragment thereof and a second antibody or antigen-binding fragment thereof of the antibody or antigen-binding fragment, as described above, wherein the first antibody or antigen-binding fragment thereof and the second antibody or antigen binding fragment thereof exhibit synergistic activity or a therapeutically effective amount of the pharmaceutical composition described above.

In some embodiments, the method of preventing or treating a SARS-CoV-2 infection, comprising administering to a subject in need thereof a therapeutically effective amount of a first antibody or antigen-binding fragment thereof and a second antibody or antigen-binding fragment thereof of the antibody or antigen-binding fragment, as described above, wherein the first antibody or antigen-binding fragment thereof and the second antibody or antigen binding fragment thereof exhibit synergistic activity or a therapeutically effective amount of the pharmaceutical composition described above. In some embodiments, the first antibody or antigen-binding fragment thereof is administered before, after, or concurrently with the second antibody or antigen-binding fragment thereof.

In some embodiments, the first antibody or antigen-binding fragment thereof and the second antibody or antigen-binding fragment thereof can be any combinations of the antibody or antigen-binding fragment thereof comprising a heavy chain and a light chain that comprise the respective amino acid sequences described herein.

In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine, or an interferon. In some embodiments, the interferon is an interferon-α or an interferon-β.

In some embodiments, the antibody or antigen-binding fragment thereof is administered before, after, or concurrently with the second therapeutic agent or therapy. In some embodiments, the antibody or antigen-binding fragment thereof is administered to the subject intravenously, subcutaneously, or intraperitoneally. In some embodiments, the antibody or antigen-binding fragment thereof is administered prophylactically or therapeutically.

The antibodies described herein can be used together with one or more of other anti-SARS-CoV-2 virus antibodies to neutralize SARS-CoV-2 virus and thereby treating SARS-CoV-2 infections.

Combination Therapies

Combination therapies may include an anti-SARS-CoV-2 antibody of the invention and any additional therapeutic agent that may be advantageously combined with an antibody of the invention or with a biologically active fragment of an antibody of the invention. The antibodies of the present invention may be combined synergistically with one or more drugs or therapy used to treat a disease or disorder associated with a viral infection, such as a SARS-CoV-2 infection. In some embodiments, the antibodies of the invention may be combined with a second therapeutic agent to ameliorate one or more symptoms of said disease. In some embodiments, the antibodies of the invention may be combined with a second antibody to provide synergistic activity in ameliorating one or more symptoms of said disease. In some embodiments, the first antibody or antigen-binding fragment thereof is administered before, after, or concurrently with the second antibody or antigen-binding fragment thereof.

For example, the antibody described herein can be used in various detection methods for use in, e.g., monitoring the progression of a SARS-CoV-2 infection; monitoring patient response to treatment for such an infection, etc. The present disclosure provides methods of detecting a neuraminidase polypeptide in a biological sample obtained from an individual. The methods generally involve: a) contacting the biological sample with a subject anti-neuraminidase antibody; and b) detecting binding, if any, of the antibody to an epitope present in the sample. In some instances, the antibody comprises a detectable label. The level of neuraminidase polypeptide detected in the biological sample can provide an indication of the stage, degree, or severity of a SARS-CoV-2 infection. The level of the neuraminidase polypeptide detected in the biological sample can provide an indication of the individual's response to treatment for a SARS-CoV-2 infection.

In some embodiments, the second therapeutic agent is another antibody to a SARS-COV-2 protein or a fragment thereof. It is contemplated herein to use a combination ("cocktail") of antibodies with broad neutralization or inhibitory activity against SARS-COV-2. In some embodiments, non-competing antibodies may be combined and administered to a subject in need thereof. In some embodiments, the antibodies comprising the combination bind to distinct non-overlapping epitopes on the protein. In some embodiments, the second antibody may possess longer half-life in human serum.

As used herein, the term "in combination with" means that additional therapeutically active component(s) may be administered prior to, concurrent with, or after the administration of the anti-SARS-COV-2 antibody of the present invention. The term "in combination with" also includes sequential or concomitant administration of an anti-SARS-COV-2 antibody and a second therapeutic agent.

The additional therapeutically active component(s) may be administered to a subject prior to administration of an anti-SARS-COV-2 antibody of the present invention. For example, a first component may be deemed to be administered "prior to" a second component if the first component is administered 1 week before, 72 hours before, 60 hours before, 48 hours before, 36 hours before, 24 hours before, 12 hours before, 6 hours before, 5 hours before, 4 hours before, 3 hours before, 2 hours before, 1 hour before, 30 minutes before, 15 minutes before, 10 minutes before, 5 minutes before, or less than 1 minute before administration of the second component. In other embodiments, the additional therapeutically active component(s) may be administered to a subject after administration of an anti-SARS-COV-2 antibody of the present invention. For example, a first component may be deemed to be administered "after" a second component if the first component is administered 1 minute after, 5 minutes after, 10 minutes after, 15 minutes after, 30 minutes after, 1 hour after, 2 hours after, 3 hours after, 4 hours after, 5 hours after, 6 hours after, 12 hours after, 24 hours after, 36 hours after, 48 hours after, 60 hours after, 72 hours after administration of the second component. In yet other embodiments, the additional therapeutically active component(s) may be administered to a subject concurrent with administration of an anti-SARS-COV-2 antibody of the present invention. "Concurrent" administration, for purposes of the present invention, includes, e.g., administration of an anti-SARS-COV-2 antibody and an additional therapeutically active component to a subject in a single dosage form, or in separate dosage forms administered to the subject within about 30 minutes or less of each other. If administered in separate dosage forms, each dosage form may be administered via the same route (e.g., both the anti-SARS-COV-2 antibody and the additional therapeutically active component may be administered intravenously, etc.); alternatively, each dosage form may be administered via a different route (e.g., the anti-SARS-COV-2 antibody may be administered intravenously, and the additional therapeutically active component may be administered orally). In any event, administering the components in a single dosage from, in separate dosage forms by the same route, or in separate dosage forms by different routes are all considered "concurrent administration," for purposes of the present disclosure. For purposes of the present disclosure, administration of an anti-SARS-COV-2 antibody "prior to," "concurrent with," or "after" (as those terms are defined hereinabove) administration of an additional therapeutically active component is considered administration of an anti-SARS-COV-2 antibody "in combination with" an additional therapeutically active component.

The present invention includes pharmaceutical compositions in which an anti-SARS-COV-2 antibody of the present invention is co-formulated with one or more of the additional therapeutically active component(s) as described elsewhere herein.

Administration Regimens

According to certain embodiments, a single dose of an anti-SARS-COV-2 antibody of the invention (or a pharmaceutical composition comprising a combination of an anti-SARS-COV-2 antibody and any of the additional therapeutically active agents mentioned herein) may be administered to a subject in need thereof. According to certain embodiments of the present invention, multiple doses of an anti-SARS-COV-2 antibody (or a pharmaceutical composition comprising a combination of an anti-SARS-COV-2 antibody and any of the additional therapeutically active agents mentioned herein) may be administered to a subject over a defined time course. The methods according to this aspect of the invention comprise sequentially administering to a subject multiple doses of an anti-SARS-COV-2 antibody of the invention. As used herein, "sequentially administering" means that each dose of anti-SARS-COV-2 antibody is administered to the subject at a different point in time, e.g., on different days separated by a predetermined interval (e.g., hours, days, weeks or months). The present invention includes methods which comprise sequentially administering to the patient a single initial dose of an anti-SARS-COV-2 antibody, followed by one or more secondary doses of the anti-SARS-COV-2 antibody, and optionally followed by one or more tertiary doses of the anti-SARS-COV-2 antibody.

The terms "initial dose," "secondary doses," and "tertiary doses," refer to the temporal sequence of administration of the anti-SARS-COV-2 antibody of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of anti-SARS-COV-2 antibody, but generally may differ from one another in terms of frequency of administration. In some embodiments, however, the amount of anti-SARS-COV-2 antibody contained in the initial, secondary and/or tertiary doses varies from one another (e.g., adjusted up or down as appropriate) during the course of treatment. In some embodiments, two or more (e.g., 2, 3, 4, or 5) doses are administered at the beginning of the treatment regimen as "loading doses" followed by subsequent doses that are administered on a less frequent basis (e.g., "maintenance doses").

In certain exemplary embodiments of the present invention, each secondary and/or tertiary dose is administered 1 to 48 hours (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) after the immediately preceding dose. The phrase "the immediately preceding dose," as used herein, means, in a sequence of multiple administrations, the dose of anti-SARS-COV-2 antibody, which is administered to a patient prior to the administration of the very next dose in the sequence with no intervening doses.

The methods, according to this aspect of the invention, may comprise administering to a patient any number of secondary and/or tertiary doses of an anti-SARS-COV-2 antibody. For example, In some embodiments, only a single secondary dose is administered to the patient. In other embodiments, two or more (e.g., 2, 3, 4, 5, 6, 7, 8, or more) secondary doses are administered to the patient. Likewise, In some embodiments, only a single tertiary dose is administered to the patient. In other embodiments, two or more (e.g., 2, 3, 4, 5, 6, 7, 8, or more) tertiary doses are administered to the patient.

In some embodiments of the invention, the frequency at which the secondary and/or tertiary doses are administered to a patient can vary over the course of the treatment regimen. The frequency of administration may also be adjusted during the course of treatment by a physician depending on the needs of the individual patient following clinical examination.

Diagnostic Uses of the Antibodies

The anti-SARS-COV-2 antibodies of the present invention may be used to detect and/or measure SARS-COV-2 in a sample, e.g., for diagnostic purposes. Some embodiments contemplate the use of one or more antibodies of the present invention in assays to detect a SARS-COV-2-associated-disease or disorder. Exemplary diagnostic assays for SARS-COV-2 may comprise, e.g., contacting a sample, obtained from a patient, with an anti-SARS-COV-2 antibody of the invention, wherein the anti-SARS-COV-2 antibody is labeled with a detectable label or reporter molecule or used as a capture ligand to selectively isolate SARS-COV-2 from patient samples. Alternatively, an unlabeled anti-SARS-COV-2 antibody can be used in diagnostic applications in combination with a secondary antibody, which is itself detectably labeled. The detectable label or reporter molecule can be a radioisotope, such as H, C, P, S, or I; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure SARS-COV-2 in a sample include enzyme-linked immunosorbent assay (ELISA), radioimmunoassay (RIA), and fluorescence-activated cell sorting (FACS).

In another aspect, this disclosure further provides a method for detecting the presence of SARS CoV-2 in a sample comprising the steps of: (i) contacting a sample with the antibody or antigen-binding fragment thereof described above; and (ii) determining binding of the antibody or antigen-binding fragment to one or more SARS CoV-2 antigens, wherein binding of the antibody to the one or more SARS CoV-2 antigens is indicative of the presence of SARS CoV-2 in the sample.

In some embodiments, the SARS-CoV-2 antigen comprises a S polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is conjugated to a label. In some embodiments, the step of detecting comprises contacting a secondary antibody with the antibody or antigen-binding fragment thereof and wherein the secondary antibody comprises a label. In some embodiments, the label includes a fluorescent label, a chemiluminescent label, a radiolabel, and an enzyme.

In some embodiments, the step of detecting comprises detecting fluorescence or chemiluminescence. In some embodiments, the step of detecting comprises a competitive binding assay or ELISA.

In some embodiments, the method further comprises binding the sample to a solid support. In some embodiments, the solid support includes microparticles, microbeads, magnetic beads, and an affinity purification column.

Samples that can be used in SARS-COV-2 diagnostic assays according to the present invention include any tissue or fluid sample obtainable from a patient, which contains detectable quantities of either SARS-COV-2 protein, or fragments thereof, under normal or pathological conditions. Generally, levels of SARS-COV-2 protein in a particular sample obtained from a healthy patient (e.g., a patient not afflicted with a disease associated with SARS-COV-2) will be measured to initially establish a baseline, or standard, level of SARS-COV-2. This baseline level of SARS-COV-2 can then be compared against the levels of SARS-COV-2 measured in samples obtained from individuals suspected of having a SARS-COV-2-associated condition, or symptoms associated with such condition.

The antibodies specific for SARS-COV-2 protein may contain no additional labels or moieties, or they may contain an N-terminal or C-terminal label or moiety. In one embodiment, the label or moiety is biotin. In a binding assay, the location of a label (if any) may determine the orientation of the peptide relative to the surface upon which the peptide is bound. For example, if a surface is coated with avidin, a peptide containing an N-terminal biotin will be oriented such that the C-terminal portion of the peptide will be distal to the surface.

Definitions

To aid in understanding the detailed description of the compositions and methods according to the disclosure, a few express definitions are provided to facilitate an unambiguous disclosure of the various aspects of the disclosure. Unless otherwise defined, all technical and scientific terms used herein have the same meaning as commonly understood by one of ordinary skill in the art to which this disclosure belongs.

The term "antibody" as referred to herein includes whole antibodies and any antigen-binding fragment or single chains thereof. Whole antibodies are glycoproteins comprising at least two heavy (H) chains and two light (L) chains inter-connected by disulfide bonds. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain, $C_L$. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. The heavy chain variable region CDRs and FRs are HFR1, HCDR1, HFR2, HCDR2, HFR3, HCDR3, HFR4. The light chain variable region CDRs and FRs are LFR1, LCDR1, LFR2, LCDR2, LFR3, LCDR3, LFR4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (CIq) of the classical complement system.

The term "antigen-binding fragment or portion" of an antibody (or simply "antibody fragment or portion"), as used herein, refers to one or more fragments of an antibody that retain the ability to specifically bind to an antigen (e.g., a Spike or S protein of SARS-CoV-2 virus). It has been shown that the antigen-binding function of an antibody can be performed by fragments of a full-length antibody. Examples of binding fragments encompassed within the term "antigen-binding fragment or portion" of an antibody include (i) a Fab fragment, a monovalent fragment consisting of the VL, VH, CL and CHI domains; (ii) a F(ab')2 fragment, a bivalent fragment comprising two Fab fragments linked by a disulfide bridge at the hinge region; (iii) a Fab' fragment, which is essentially a Fab with part of the hinge region (see, FUNDAMENTAL IMMUNOLOGY (Paul ed., 3rd ed. 1993)); (iv) a Fd fragment consisting of the VH and CHI domains; (v) a Fv fragment consisting of the VL and VH domains of a single arm of an antibody, (vi) a dAb fragment (Ward et al., (1989) Nature 341:544-546), which consists of a VH domain; (vii) an isolated CDR; and (viii) a nanobody, a heavy chain variable region containing a single variable domain and two constant domains. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv or scFv); see, e.g., Bird et al. (1988) Science 242:423-426; and Huston et al. (1988) Proc. Natl. Acad. Sci. USA 85:5879-5883). Such single chain antibodies are also intended to be encompassed within the term "antigen-binding fragment or portion" of an antibody. These antibody fragments are obtained using conventional techniques known to those with skill in the art, and the fragments are screened for utility in the same manner as are intact antibodies.

An "isolated antibody," as used herein, is intended to refer to an antibody that is substantially free of other antibodies having different antigenic specificities (e.g., an isolated antibody that specifically binds to a Spike or S protein of SARS-CoV-2 virus is substantially free of antibodies that specifically bind antigens other than the neuraminidase). An isolated antibody can be substantially free of other cellular material and/or chemicals.

The terms "monoclonal antibody" or "monoclonal antibody composition" as used herein refer to a preparation of antibody molecules of single molecular composition. A monoclonal antibody composition displays a single binding specificity and affinity for a particular epitope.

The term "human antibody" is intended to include antibodies having variable regions in which both the framework and CDR regions are derived from human germline immunoglobulin sequences. Furthermore, if the antibody contains a constant region, the constant region also is derived from human germline immunoglobulin sequences. The human antibodies of the invention can include amino acid residues not encoded by human germline immunoglobulin sequences (e.g., mutations introduced by random or site-specific mutagenesis in vitro or by somatic mutation in vivo). However, the term "human antibody," as used herein, is not intended to include antibodies in which CDR sequences derived from the germline of another mammalian species, such as a mouse, have been grafted onto human framework sequences.

The term "human monoclonal antibody" refers to antibodies displaying a single binding specificity, which have variable regions in which both the framework and CDR regions are derived from human germline immunoglobulin sequences. In one embodiment, the human monoclonal antibodies can be produced by a hybridoma that includes a B cell obtained from a transgenic nonhuman animal, e.g., a transgenic mouse, having a genome comprising a human heavy chain transgene and a light chain transgene fused to an immortalized cell.

The term "recombinant human antibody," as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom (described further below), (b) antibodies isolated from a host cell transformed to express the human antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies have variable regions in which the framework and CDR regions are derived from human germline immunoglobulin sequences. In some embodiments, however, such recombinant human antibodies can be subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

The term "isotype" refers to the antibody class (e.g., IgM or IgG1) that is encoded by the heavy chain constant region genes. The phrases "an antibody recognizing an antigen" and "an antibody specific for an antigen" are used interchangeably herein with the term "an antibody which binds specifically to an antigen."

The term "human antibody derivatives" refers to any modified form of the human antibody, e.g., a conjugate of the antibody and another agent or antibody. The term "humanized antibody" is intended to refer to antibodies in which CDR sequences derived from the germline of another mammalian species, such as a mouse, have been grafted onto human framework sequences. Additional framework region modifications can be made within the human framework sequences.

The term "chimeric antibody" is intended to refer to antibodies in which the variable region sequences are derived from one species, and the constant region sequences are derived from another species, such as an antibody in which the variable region sequences are derived from a mouse antibody, and the constant region sequences are derived from a human antibody. The term can also refer to an antibody in which its variable region sequence or CDR(s) is derived from one source (e.g., an IgA1 antibody) and the constant region sequence or Fc is derived from a different source (e.g., a different antibody, such as an IgG, IgA2, IgD, IgE or IgM antibody).

The invention encompasses isolated or substantially purified nucleic acids, peptides, polypeptides or proteins. In the context of the present invention, an "isolated" nucleic acid, DNA or RNA molecule or an "isolated" polypeptide is a nucleic acid, DNA molecule, RNA molecule, or polypeptide that exists apart from its native environment and is therefore not a product of nature. An isolated nucleic acid, DNA molecule, RNA molecule or polypeptide may exist in a purified form or may exist in a non-native environment such as, for example, a transgenic host cell. A "purified" nucleic acid molecule, peptide, polypeptide or protein, or a fragment thereof, is substantially free of other cellular material, or culture medium when produced by recombinant techniques, or substantially free of chemical precursors or other chemicals when chemically synthesized. In one embodiment, an "isolated" nucleic acid is free of sequences that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A protein, peptide or polypeptide that is substantially free of cellular material includes preparations of protein, peptide or polypeptide having less than about 30%, 20%, 10%, or 5% (by dry weight) of contaminating protein. When the protein of the invention, or biologically active portion thereof, is recombinantly produced, preferably culture medium represents less than about 30%, 20%, 10%, or 5% (by dry weight) of chemical precursors or non-protein-of-interest chemicals.

The terms "polypeptide," "peptide," and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, pegylation, or any other manipulation, such as conjugation with a labeling component. As used herein, the term "amino acid" includes natural and/or unnatural or synthetic amino acids, including glycine and both the D or L optical isomers, and amino acid analogs and peptidomimetics.

A peptide or polypeptide "fragment" as used herein refers to a less than full-length peptide, polypeptide or protein. For example, a peptide or polypeptide fragment can have is at least about 3, at least about 4, at least about 5, at least about 10, at least about 20, at least about 30, at least about 40 amino acids in length, or single unit lengths thereof. For example, fragment may be 6, 7, 8, 9, 10, 11, 12, 13, 14, 15, 16, 17, or more amino acids in length. There is no upper limit to the size of a peptide fragment. However, in some embodiments, peptide fragments can be less than about 500 amino acids, less than about 400 amino acids, less than about 300 amino acids or less than about 250 amino acids in length. Preferably the peptide fragment can elicit an immune response when used to inoculate an animal. A peptide fragment may be used to elicit an immune response by inoculating an animal with a peptide fragment in combination with an adjuvant, a peptide fragment that is coupled to an adjuvant, or a peptide fragment that is coupled to arsanilic acid, sulfanilic acid, an acetyl group, or a picryl group. A peptide fragment can include a non-amide bond and can be a peptidomimetic.

As used herein, the term "conjugate" or "conjugation" or "linked" as used herein refers to the attachment of two or more entities to form one entity. A conjugate encompasses both peptide-small molecule conjugates as well as peptide-protein/peptide conjugates.

The term "recombinant," as used herein, refers to antibodies or antigen-binding fragments thereof of the invention created, expressed, isolated or obtained by technologies or methods known in the art as recombinant DNA technology which include, e.g., DNA splicing and transgenic expression. The term refers to antibodies expressed in a non-human mammal (including transgenic non-human mammals, e.g., transgenic mice), or a cell (e.g., CHO cells) expression system or isolated from a recombinant combinatorial human antibody library.

A "nucleic acid" or "polynucleotide" refers to a DNA molecule (for example, but not limited to, a cDNA or genomic DNA) or an RNA molecule (for example, but not limited to, an mRNA), and includes DNA or RNA analogs. A DNA or RNA analog can be synthesized from nucleotide analogs. The DNA or RNA molecules may include portions that are not naturally occurring, such as modified bases, modified backbone, deoxyribonucleotides in an RNA, etc. The nucleic acid molecule can be single-stranded or double-stranded.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98% or 99% of the nucleotide bases, as measured by any well-known algorithm of sequence identity, such as FASTA, BLAST or GAP, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 90% sequence identity, even more preferably at least 95%, 98% or 99% sequence identity. Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. See, e.g., Pearson (1994) Methods Mol. Biol. 24: 307-331, which is herein incorporated by reference. Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45, herein incorporated by reference. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions, and other modifications, including conservative amino acid substitutions. For instance, GCG software contains programs such as GAP and BESTFIT, which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215: 403-410 and (1997) Nucleic Acids Res. 25:3389-3402, each of which is herein incorporated by reference.

As used herein, the term "affinity" refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity, which reflects a 1:1 interaction between members of a binding pair (e.g., antibody and antigen). The affinity of a molecule X for its partner Y can generally be represented by the dissociation constant (KD). Affinity can be measured by common methods known in the art, including those described herein.

The term "specifically binds," or "binds specifically to," or the like, refers to an antibody that binds to a single epitope, e.g., under physiologic conditions., but which does not bind to more than one epitope. Accordingly, an antibody that specifically binds to a polypeptide will bind to an epitope that present on the polypeptide, but which is not present on other polypeptides. Specific binding can be characterized by an equilibrium dissociation constant of at least about $1\times10^{-8}$ M or less (e.g., a smaller KD denotes a tighter binding). Methods for determining whether two molecules specifically bind are well known in the art and include, for example, equilibrium dialysis, surface plasmon resonance, and the like. As described herein, antibodies have been identified by surface plasmon resonance, e.g., BIACORE™, which bind specifically to a Spike or S protein of SARS-CoV-2 virus.

Preferably, the antibody binds to a Spike or S protein with "high affinity," namely with a KD of 1×10-7 M or less, more preferably 5×10-8 M or less, more preferably 3×10-8 M or less, more preferably 1×10-8 M or less, more preferably 5×10-9 M or less or even more preferably 1×10-9 M or less, as determined by surface plasmon resonance, e.g., BIACORE. The term "does not substantially bind" to a protein or cells, as used herein, means does not bind or does not bind with a high affinity to the protein or cells, i.e., binds to the protein or cells with a KD of 1×10-6 M or more, more preferably 1×10-5 M or more, more preferably 1×10-4 M or more, more preferably 1×10-3 M or more, even more preferably 1×10-2 M or more.

The term "Kassoc" or "Ka," as used herein, is intended to refer to the association rate of a particular antibody-antigen interaction, whereas the term "Kdis" or "Kd," as used herein, is intended to refer to the dissociation rate of a particular antibody-antigenn interaction. The term "KD," as used herein, is intended to refer to the dissociation constant, which is obtained from the ratio of Kd to Ka (i.e., Kd/Ka) and is expressed as a molar concentration (M). KD values for antibodies can be determined using methods well established in the art. A preferred method for determining the KD of an antibody is by using surface plasmon resonance, preferably using a biosensor system such as a BIACORE system.

Antibodies that "compete with another antibody for binding to a target" refer to antibodies that inhibit (partially or completely) the binding of the other antibody to the target. Whether two antibodies compete with each other for binding to a target, i.e., whether and to what extent one antibody inhibits the binding of the other antibody to a target, may be determined using known competition experiments. In some embodiments, an antibody competes with, and inhibits binding of another antibody to a target by at least 10%, 20%, 30%, 40%, 50%, 60%, 70%, 80%, 90% or 100%. The level of inhibition or competition may be different depending on which antibody is the "blocking antibody" (i.e., the cold antibody that is incubated first with the target). Competition assays can be conducted as described, for example, in Ed Harlow and David Lane, Cold Spring Harb Protoc; 2006 or in Chapter 11 of "Using Antibodies" by Ed Harlow and David Lane, Cold Spring Harbor Laboratory Press, Cold Spring Harbor, NY, USA 1999. Competing antibodies bind to the same epitope, an overlapping epitope or to adjacent epitopes (e.g., as evidenced by steric hindrance). Other competitive binding assays include: solid phase direct or indirect radioimmunoassay (RIA), solid phase direct or indirect enzyme immunoassay (EIA), sandwich competition assay (see Stahli et al., Methods in Enzymology 9:242 (1983)); solid phase direct biotin-avidin EIA (see Kirkland et al., J. Immunol. 137:3614 (1986)); solid phase direct labeled assay, solid phase direct labeled sandwich assay (see Harlow and Lane, Antibodies: A Laboratory Manual, Cold Spring Harbor Press (1988)); solid phase direct label RIA using 1-125 label (see Morel et al., Mol. Immunol. 25(1):7 (1988)); solid phase direct biotin-avidin EIA (Cheung et al., Virology 176:546 (1990)); and direct labeled RIA. (Moldenhauer et al., Scand. J. Immunol. 32:77 (1990)).

The term "epitope" as used herein refers to an antigenic determinant that interacts with a specific antigen-binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In some embodiments, epitopes may include determinants that are chemically active surface groupings of molecules such as amino acids, sugar side chains, phosphoryl groups, or sulfonyl groups, and, In some embodiments, may have specific three-dimensional structural characteristics, and/or specific charge characteristics. An epitope typically includes at least 3, 4, 5, 6, 7, 8, 9, 10, 11, 12, 13, 14 or 15 amino acids in a unique spatial conformation. Methods for determining what epitopes are bound by a given antibody (i.e., epitope mapping) are well known in the art and include, for example, immunoblotting and immune-precipitation assays, wherein overlapping or contiguous peptides from a Spike or S protein are tested for reactivity with a given antibody. Methods of determining spatial conformation of epitopes include techniques in the art and those described herein, for example, x-ray crystallography and 2-dimensional nuclear magnetic resonance (see, e.g., Epitope Mapping Protocols in Methods in Molecular Biology, Vol. 66, G. E. Morris, Ed. (1996)).

The term "epitope mapping" refers to the process of identification of the molecular determinants for antibody-antigen recognition.

The term "binds to an epitope" or "recognizes an epitope" with reference to an antibody or antibody fragment refers to continuous or discontinuous segments of amino acids within an antigen. Those of skill in the art understand that the terms do not necessarily mean that the antibody or antibody fragment is in direct contact with every amino acid within an epitope sequence.

The term "binds to the same epitope" with reference to two or more antibodies means that the antibodies bind to the same, overlapping or encompassing continuous or discontinuous segments of amino acids. Those of skill in the art understand that the phrase "binds to the same epitope" does not necessarily mean that the antibodies bind to or contact exactly the same amino acids. The precise amino acids that the antibodies contact can differ. For example, a first antibody can bind to a segment of amino acids that is completely encompassed by the segment of amino acids bound by a second antibody. In another example, a first antibody binds one or more segments of amino acids that significantly overlap the one or more segments bound by the second antibody. For the purposes herein, such antibodies are considered to "bind to the same epitope."

As used herein, the term "immune response" refers to a biological response within a vertebrate against foreign agents, which response protects the organism against these agents and diseases caused by them. An immune response is mediated by the action of a cell of the immune system (for example, a T lymphocyte, B lymphocyte, natural killer (NK) cell, macrophage, eosinophil, mast cell, dendritic cell or neutrophil) and soluble macromolecules produced by any of these cells or the liver (including antibodies, cytokines, and complement) that results in selective targeting, binding to, damage to, destruction of, and/or elimination from the vertebrate's body of invading pathogens, cells or tissues infected with pathogens, cancerous or other abnormal cells, or, in cases of autoimmunity or pathological inflammation, normal human cells or tissues. An immune reaction includes, e.g., activation or inhibition of a T cell, e.g., an effector T cell or a Th cell, such as a CD4+ or CD8+ T cell, or the inhibition of a Treg cell.

The term "detectable label" as used herein refers to a molecule capable of detection, including, but not limited to, radioactive isotopes, fluorescers, chemiluminescers, chromophores, enzymes, enzyme substrates, enzyme cofactors, enzyme inhibitors, chromophores, dyes, metal ions, metal sols, ligands (e.g., biotin, avidin, streptavidin or haptens), intercalating dyes and the like. The term "fluorescer" refers to a substance or a portion thereof that is capable of exhibiting fluorescence in the detectable range.

In many embodiments, the terms "subject" and "patient" are used interchangeably irrespective of whether the subject has or is currently undergoing any form of treatment. As used herein, the terms "subject" and "subjects" may refer to any vertebrate, including, but not limited to, a mammal (e.g., cow, pig, camel, llama, horse, goat, rabbit, sheep, hamsters, guinea pig, cat, dog, rat, and mouse, a non-human primate (for example, a monkey, such as a cynomolgus monkey, chimpanzee, etc.) and a human). The subject may be a human or a non-human. In more exemplary aspects, the mammal is a human. As used herein, the expression "a subject in need thereof" or "a patient in need thereof" means a human or non-human mammal that exhibits one or more symptoms or indications of disorders (e.g., neuronal disorders, autoimmune diseases, and cardiovascular diseases), and/or who has been diagnosed with inflammatory disorders. In some embodiments, the subject is a mammal. In some embodiments, the subject is human.

As used herein, the term "disease" is intended to be generally synonymous and is used interchangeably with, the terms "disorder" and "condition" (as in medical condition), in that all reflect an abnormal condition (e.g., inflammatory disorder) of the human or animal body or of one of its parts that impairs normal functioning, is typically manifested by distinguishing signs and symptoms, and causes the human or animal to have a reduced duration or quality of life.

As used herein, the term "treating" or "treatment" of any disease or disorder refers in one embodiment, to ameliorating the disease or disorder (i.e., arresting or reducing the development of the disease or at least one of the clinical symptoms thereof). In another embodiment, "treating" or "treatment" refers to ameliorating at least one physical parameter, which may not be discernible by the patient. In yet another embodiment, "treating" or "treatment" refers to modulating the disease or disorder, either physically, (e.g., stabilization of a discernible symptom), physiologically, (e.g., stabilization of a physical parameter), or both. In yet another embodiment, "treating" or "treatment" refers to preventing or delaying the onset or development or progression of the disease or disorder.

The terms "prevent," "preventing," "prevention," "prophylactic treatment" and the like refer to reducing the probability of developing a disorder or condition in a subject, who does not have, but is at risk of or susceptible to developing a disorder or condition.

The terms "decrease," "reduced," "reduction," "decrease," or "inhibit" are all used herein generally to mean a decrease by a statistically significant amount. However, for avoidance of doubt, "reduced," "reduction" or "decrease" or "inhibit" means a decrease by at least 10% as compared to a reference level, for example, a decrease by at least about 20%, or at least about 30%, or at least about 40%, or at least about 50%, or at least about 60%, or at least about 70%, or at least about 80%, or at least about 90% or up to and including a 100% decrease (e.g., absent level as compared to a reference sample), or any decrease between 10-100% as compared to a reference level.

As used herein, the term "agent" denotes a chemical compound, a mixture of chemical compounds, a biological macromolecule (such as a nucleic acid, an antibody, a protein or portion thereof, e.g., a peptide), or an extract made from biological materials such as bacteria, plants, fungi, or animal (particularly mammalian) cells or tissues. The activity of such agents may render it suitable as a "therapeutic agent," which is a biologically, physiologically, or pharmacologically active substance (or substances) that acts locally or systemically in a subject.

As used herein, the terms "therapeutic agent," "therapeutic capable agent," or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder, or condition; and generally counteracting a disease, symptom, disorder or pathological condition.

The term "therapeutic effect" is art-recognized and refers to a local or systemic effect in animals, particularly mammals, and more particularly humans caused by a pharmacologically active substance.

The term "effective amount," "effective dose," or "effective dosage" is defined as an amount sufficient to achieve or at least partially achieve a desired effect. A "therapeutically effective amount" or "therapeutically effective dosage" of a drug or therapeutic agent is any amount of the drug that, when used alone or in combination with another therapeutic agent, promotes disease regression evidenced by a decrease in severity of disease symptoms, an increase in frequency and duration of disease symptom-free periods, or a prevention of impairment or disability due to the disease affliction. A "prophylactically effective amount" or a "prophylactically effective dosage" of a drug is an amount of the drug that, when administered alone or in combination with another therapeutic agent to a subject at risk of developing a disease or of suffering a recurrence of disease, inhibits the development or recurrence of the disease. The ability of a therapeutic or prophylactic agent to promote disease regression or inhibit the development or recurrence of the disease can be evaluated using a variety of methods known to the skilled practitioner, such as in human subjects during clinical trials, in animal model systems predictive of efficacy in humans, or by assaying the activity of the agent in in vitro assays.

Doses are often expressed in relation to bodyweight. Thus, a dose which is expressed as [g, mg, or other unit]/kg (or g, mg etc.) usually refers to [g, mg, or other unit] "per kg (or g, mg etc.) bodyweight," even if the term "bodyweight" is not explicitly mentioned.

As used herein, the term "composition" or "pharmaceutical composition" refers to a mixture of at least one component useful within the invention with other components, such as carriers, stabilizers, diluents, dispersing agents, suspending agents, thickening agents, and/or excipients. The pharmaceutical composition facilitates administration of one or more components of the invention to an organism.

As used herein, the term "pharmaceutically acceptable" refers to a material, such as a carrier or diluent, which does not abrogate the biological activity or properties of the composition, and is relatively non-toxic, i.e., the material may be administered to an individual without causing undesirable biological effects or interacting in a deleterious manner with any of the components of the composition in which it is contained.

As used herein, the term "pharmaceutically acceptable carrier" includes a pharmaceutically acceptable salt, pharmaceutically acceptable material, composition or carrier, such as a liquid or solid filler, diluent, excipient, solvent or encapsulating material, involved in carrying or transporting a compound(s) of the present invention within or to the subject such that it may perform its intended function. Typically, such compounds are carried or transported from one organ, or portion of the body, to another organ, or portion of the body. Each salt or carrier must be "acceptable" in the sense of being compatible with the other ingredients of the formulation and not injurious to the subject. Some examples of materials that may serve as pharmaceutically acceptable carriers include: sugars, such as lactose, glucose, and sucrose; starches, such as corn starch and potato starch; cellulose, and its derivatives, such as sodium carboxymethyl cellulose, ethyl cellulose, and cellulose acetate; powdered tragacanth; malt; gelatin; talc; excipients, such as cocoa butter and suppository waxes; oils, such as peanut oil, cottonseed oil, safflower oil, sesame oil, olive oil, corn oil, and soybean oil; glycols, such as propylene glycol; polyols, such as glycerin, sorbitol, mannitol, and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; diluent; granulating agent; lubricant; binder; disintegrating agent; wetting agent; emulsifier; coloring agent; release agent; coating agent; sweetening agent; flavoring agent; perfuming agent; preservative; antioxidant; plasticizer; gelling agent; thickener; hardener; setting agent; suspending agent; surfactant; humectant; carrier; stabilizer; and other non-toxic compatible substances employed in pharmaceutical formulations, or any combination thereof. As used herein, "pharmaceutically acceptable carrier" also includes any and all coatings, antibacterial and antifungal agents, and absorption delaying agents, and the like that are compatible with the activity of one or more components of the invention, and are physiologically acceptable to the subject. Supplementary active compounds may also be incorporated into the compositions.

"Combination" therapy, as used herein, unless otherwise clear from the context, is meant to encompass administration of two or more therapeutic agents in a coordinated fashion and includes, but is not limited to, concurrent dosing. Specifically, combination therapy encompasses both co-administration (e.g., administration of a co-formulation or simultaneous administration of separate therapeutic compositions) and serial or sequential administration, provided that administration of one therapeutic agent is conditioned in some way on the administration of another therapeutic agent. For example, one therapeutic agent may be administered only after a different therapeutic agent has been administered and allowed to act for a prescribed period of time. See, e.g., Kohrt et al. (2011) Blood 117:2423.

As used herein, the term "co-administration" or "co-administered" refers to the administration of at least two agent(s) or therapies to a subject. In some embodiments, the co-administration of two or more agents/therapies is concurrent. In other embodiments, a first agent/therapy is administered prior to a second agent/therapy. Those of skill in the art understand that the formulations and/or routes of administration of the various agents/therapies used may vary.

As used herein, the term "contacting," when used in reference to any set of components, includes any process whereby the components to be contacted are mixed into the same mixture (for example, are added into the same compartment or solution), and does not necessarily require actual physical contact between the recited components. The recited components can be contacted in any order or any combination (or sub-combination) and can include situations where one or some of the recited components are subsequently removed from the mixture, optionally prior to addition of other recited components. For example, "contacting A with B and C" includes any and all of the following situations: (i) A is mixed with C, then B is added to the mixture; (ii) A and B are mixed into a mixture; B is removed from the mixture, and then C is added to the mixture; and (iii) A is added to a mixture of B and C.

"Sample," "test sample," and "patient sample" may be used interchangeably herein. The sample can be a sample of serum, urine plasma, amniotic fluid, cerebrospinal fluid, cells, or tissue. Such a sample can be used directly as obtained from a patient or can be pre-treated, such as by filtration, distillation, extraction, concentration, centrifugation, inactivation of interfering components, addition of reagents, and the like, to modify the character of the sample in some manner as discussed herein or otherwise as is known in the art. The terms "sample" and "biological sample" as used herein generally refer to a biological material being tested for and/or suspected of containing an analyte of interest such as antibodies. The sample may be any tissue sample from the subject. The sample may comprise protein from the subject.

As used herein, the term "in vitro" refers to events that occur in an artificial environment, e.g., in a test tube or reaction vessel, in cell culture, etc., rather than within a multi-cellular organism.

As used herein, the term "in vivo" refers to events that occur within a multi-cellular organism, such as a non-human animal.

As used herein, the singular forms "a," "an," and "the" include plural references unless the context clearly dictates otherwise.

As used herein, the terms "including," "comprising," "containing," or "having" and variations thereof are meant to encompass the items listed thereafter and equivalents thereof as well as additional subject matter unless otherwise noted.

As used herein, the phrases "in one embodiment," "in various embodiments," "in some embodiments," and the like are used repeatedly. Such phrases do not necessarily refer to the same embodiment, but they may unless the context dictates otherwise.

As used herein, the terms "and/or" or "/" means any one of the items, any combination of the items, or all of the items with which this term is associated.

As used herein, the word "substantially" does not exclude "completely," e.g., a composition which is "substantially free" from Y may be completely free from Y. Where necessary, the word "substantially" may be omitted from the definition of the invention.

As used herein, the term "each," when used in reference to a collection of items, is intended to identify an individual item in the collection but does not necessarily refer to every item in the collection. Exceptions can occur if explicit disclosure or context clearly dictates otherwise.

As used herein, the term "approximately" or "about," as applied to one or more values of interest, refers to a value that is similar to a stated reference value. In some embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value). Unless indicated otherwise herein, the term "about" is intended to include values, e.g., weight percents, proximate to the recited range that are equivalent in terms of the functionality of the individual ingredient, the composition, or the embodiment.

As disclosed herein, a number of ranges of values are provided. It is understood that each intervening value, to the tenth of the unit of the lower limit, unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither, or both limits are included in the smaller ranges is also encompassed within the invention, subject to any specifically excluded limit in the stated range. Where the stated range includes one or both of the limits, ranges excluding either or both of those included limits are also included in the invention.

The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

All methods described herein are performed in any suitable order unless otherwise indicated herein or otherwise clearly contradicted by context. In regard to any of the methods provided, the steps of the method may occur simultaneously or sequentially. When the steps of the method occur sequentially, the steps may occur in any order, unless noted otherwise. In cases in which a method comprises a combination of steps, each and every combination or sub-combination of the steps is encompassed within the scope of the disclosure, unless otherwise noted herein.

Each publication, patent application, patent, and other reference cited herein is incorporated by reference in its entirety to the extent that it is not inconsistent with the present disclosure. Publications disclosed herein are provided solely for their disclosure prior to the filing date of the present invention. Nothing herein is to be construed as an admission that the present invention is not entitled to antedate such publication by virtue of prior invention. Further, the dates of publication provided may be different from the actual publication dates, which may need to be independently confirmed.

It is understood that the examples and embodiments described herein are for illustrative purposes only and that various modifications or changes in light thereof will be suggested to persons skilled in the art and are to be included within the spirit and purview of this application and scope of the appended claims.

EXAMPLES

Example 1

This example describes the materials and methods used in the subsequent EXAMPLES below.

Study Participants.

To isolate and characterize anti-SARS-CoV-2 RBD antibodies from vaccinees, a cohort of 20 individuals that participated in either the Moderna or Pfizer/BioNTech phase 3 vaccine clinical trial and no prior history of SARS-CoV-2 infection were recruited at the NIH Blood Center and the Rockefeller University Hospital for blood donation. Eligible participants included adults at least 18 years of age with no known heart, lung, kidney disease, or bleeding disorders, no history of HIV-1 or malaria infection. All participants were asymptomatic at the time of the study visit and had received a complete two-dose regimen of either mRNA vaccine. Informed consent was obtained from all participants, and the study was conducted in accordance with Good Clinical Practice. The study visits and blood draws were reviewed and approved under the National Institutes of Health's Federalwide Assurance (FWA00005897) in accordance with Federal regulations 45 CFR 46 and 21 CFR 5 by the NIH Intramural Research Program IRB committee (IRB #99CC0168, Collection and Distribution of Blood Components from Healthy Donors for In vitro Research Use) and by the Institutional Review Board of the Rockefeller University (IRB #DRO-1006, Peripheral Blood of Coronavirus Survivors to Identify Virus-Neutralizing Antibodies). For detailed participant characteristics, see Table 1.

Blood Samples Processing and Storage.

Samples collected at NIH were drawn from participants at the study visit and processed within 24 hours. Briefly, whole blood samples were subjected to Ficoll gradient centrifugation after 1:1 dilution in PBS. Plasma and PBMC samples were obtained through phase separation of plasma layer and Buffy coat phase, respectively. PBMCs were further prepared through centrifugation, red blood cells lysis, and washing steps, and stored in CellBanker cell freezing media (Amsbio). All samples were aliquoted and stored at −80° C. and shipped on dry ice. Prior to experiments, aliquots of plasma samples were heat-inactivated (56° ° C. for 1 hour) and then stored at 4° C. Peripheral Blood Mononuclear Cells (PBMCs) obtained from samples collected at Rockefeller University were purified as previously reported (Gaebler, C. et al. bioRxiv, (2020); Robbiani, D. F. et al. Nature 584, 437-442 (2020)) by gradient centrifugation and stored in liquid nitrogen in the presence of FCS and DMSO. Heparinized plasma samples were aliquoted and stored at −20 C or less. Prior to experiments, aliquots of plasma samples were heat-inactivated (56 C for 1 hour) and then stored at 4° C.

ELISAs

ELISAs to evaluate antibodies binding to SARS-CoV-2 S (BioHub), RBD, and additional mutated RBDs were performed by coating high-binding 96-half-well plates (Corning 3690) with 50 µl per well of a 1 µg/ml protein solution in PBS overnight at 4° C. Plates were washed 6 times with washing buffer (1×PBS with 0.05% Tween-20 (Sigma-Aldrich)) and incubated with 170 µl per well blocking buffer (1×PBS with 2% BSA and 0.05% Tween-20 (Sigma)) for 1 h at room temperature. Immediately after blocking, monoclonal antibodies or plasma samples were added in PBS and incubated for 1 h at room temperature. Plasma samples were assayed at a 1:66.6 (RU samples) or a 1:33.3 (NIH samples) starting dilution and 7 additional threefold serial dilutions. Monoclonal antibodies were tested at 10 µg/ml starting concentration and 10 additional fourfold serial dilutions. Plates were washed 6 times with washing buffer and then incubated with anti-human IgG, IgM, or IgA secondary antibody conjugated to horseradish peroxidase (HRP) (Jackson Immuno Research 109-036-088 109-035-129 and Sigma A0295) in blocking buffer at a 1:5,000 dilution (IgM and IgG) or 1:3,000 dilution (IgA). Plates were developed by addition of the HRP substrate, TMB (ThermoFisher) for 10 min (plasma samples) or 4 minutes (monoclonal antibodies), then the developing reaction was stopped by adding 50 µl 1 M $H_2SO_4$ and absorbance was measured at 450 nm with an ELISA microplate reader (FluoStar Omega, BMG Labtech) with Omega and Omega MARS software for analysis. For plasma samples, a positive control (plasma from participant COV72 (Gaebler, C. et al. bioRxiv, (2020); Robbiani, D. F. et al. Nature 584, 437-442 (2020)), diluted 66.6-fold and with seven additional threefold serial dilutions in PBS) was added to every assay plate for validation. The average of its signal was used for normalization of all of the other values on the same plate with Excel software before calculating the area under the curve using Prism V8.4 (GraphPad). For monoclonal antibodies, the EC50 was determined using four-parameter nonlinear regression (GraphPad Prism V8.4).

Expression of RBD Proteins

Mammalian expression vectors encoding the RBDs of SARS-CoV-2 (GenBank MN985325.1; S protein residues 319-539) and eight additional mutant RBD proteins (E484K, Q493R, R346S, N493K, N440K, V367F, A475V, S477N, and V483A) with an N-terminal human IL-2 or Mu phosphatase signal peptide were previously described (Barnes, C. O. et al. Cell 182, 828-842 e816 (2020)).

Cells and Viruses

293T/ACE2.cl22 and HT1080 ACE2.cl14 cells (Schmidt, F. et al. J Exp Med 217 (2020)) were cultured in Dulbecco's Modified Eagle Medium (DMEM) supplemented with 10% fetal bovine serum (FBS) at 37° C. and 5% $CO_2$. Cells were periodically tested for contamination with mycoplasma or retroviruses.

rVSV/SARS-CoV-2/GFP chimeric virus stocks were generated by infecting 293T/ACE2.cl22 cells. The supernatant was harvested 1 day post infection (dpi), cleared of cellular debris, and stored at −80° C. A plaque purified variant designated rVSV/SARS-CoV-2/GFP$_{2E1}$ that encodes D215G/R683G substitutions was used in these studies.

Selection and Analysis of Antibody Escape Mutations

For the selection of monoclonal antibody-resistant spike variants, an rVSV/SARS-CoV-2/GFP$_{2E1}$ (Schmidt, F. et al. J Exp Med 217 (2020)) population containing 106 infectious units was incubated with monoclonal antibodies (10 µg/ml passage 10-40 µg/ml for 1 hr at 37° C. Then, the virus-antibody mixtures were incubated with 5×10$^5$ 293T/ACE2cl.22 cells in 6-well plates. At 1 day post infection, media was replaced with fresh media containing the equivalent concentrations of antibodies. The supernatant was harvested 2 days after infection, and 150 µl of the cleared supernatant was used to infect cells for passage 2, while 150 µl was subjected to RNA extraction and sequencing.

For identification of putative antibody resistance mutations, RNA was extracted using NucleoSpin 96 Virus Core Kit (Macherey-Nagel). The RNA was reversed transcribed using the SuperScript VILO cDNA Synthesis Kit (Thermo Fisher Scientific). KOD Xtreme Hot Start DNA Polymerase (Millipore Sigma) was used for amplification of cDNA using primers flanking the S-encoding sequence. The PCR products were purified and sequenced as previously described (Weisblum, Y. et al. Elife 9 (2020)). Briefly, tagmentation reactions were performed using 1 ul diluted cDNA, 0.25 µl Nextera TDE1 Tagment DNA enzyme (catalog no. 15027865), and 1.25 µl TD Tagment DNA buffer (catalog no. 15027866; Illumina). Next, the DNA was ligated to unique i5/i7 barcoded primer combinations using the Illumina Nextera XT Index Kit v2 and KAPA HiFi HotStart ReadyMix (2×; KAPA Biosystems) and purified using AmPure Beads XP (Agencourt), after which the samples were pooled into one library and subjected to paired-end sequencing using Illumina MiSeq Nano 300 V2 cycle kits (Illumina) at a concentration of 12 pM.

For analysis of the sequencing data, the raw paired-end reads were pre-processed to remove trim adapter sequences and to remove low-quality reads (Phred quality score <20) using BBDuk. Reads were mapped to the rVSV/SARS-CoV-2/GFP sequence using Geneious Prime (Version 2020.1.2). Mutations were annotated using Geneious Prime, with a P-value cutoff of 10 6.

SARS-CoV-2 Pseudotyped Reporter Virus

A panel of plasmids expressing RBD-mutant SAR-COV-2 spike proteins in the context of pSARS-CoV-2-$S_{\Delta 19}$ have been described previously (Weisblum, Y. et al. Elife 9 (2020)). Additional substitutions were introduced using either PCR primer-mediated mutagenesis or with synthetic gene fragments (IDT) followed by Gibson assembly. The mutants E484K and KEN (K417N+E484K+N501Y) were constructed in the context of a pSARS-CoV-2-$S_{\Delta 19}$ variant with a mutation in the furin cleavage site (R683G). The NT50s and IC50 of these pseudotypes were compared to a wildtype SARS-CoV-2 (NC_045512) spike sequence carrying R683G in the subsequent analyses, as appropriate.

Generation of SARS-CoV-2 pseudotyped HIV-1 particles was performed as previously described (Robbiani, D. F. et al. Nature 584, 437-442 (2020)). Briefly, 293T cells were transfected with pNL4-3ΔEnv-nanoluc and pSARS-CoV-2-$S_{\Delta 19}$ and pseudotyped virus stocks were harvested 48 hours after transfection, filtered, and stored at −80° C.

SARS-CoV-2 Pseudotype Neutralization Assays

Plasma or monoclonal antibodies from vaccine recipients were four-fold or five-fold serially diluted and then incubated with SARS-CoV-2 pseudotyped HIV-1 reporter virus for 1 h at 37° C. The antibody and pseudotype virus mixture was added to $293T_{Ace2}$ cells (Robbiani, D. F. et al. Nature 584, 437-442 (2020)) (for comparisons of plasma from COVID-19-convalescents and vaccine recipients) or HT1080ACE2.cl14 cells (for analysis of spike mutants with vaccine recipient plasma or monoclonal antibodies). After 48 h, cells were washed with PBS and lysed with Luciferase Cell Culture Lysis 5× reagent (Promega), and Nanoluc Luciferase activity in lysates was measured using the Nano-Glo Luciferase Assay System (Promega) with the Glomax Navigator (Promega). The relative luminescence units were normalized to those derived from cells infected with SARS-CoV-2 pseudotyped virus in the absence of plasma or monoclonal antibodies. The half-maximal neutralization titers for plasma ($NT_{50}$) or half-maximal and 90% inhibitory concentrations for monoclonal antibodies ($IC_{50}$ and $IC_{90}$, respectively) were determined using four-parameter nonlinear regression (least-squares regression method without weighting; constraints: top=1, bottom=0) (GraphPad Prism).

Biotinylation of Viral Protein for Use in Flow Cytometry

Purified and Avi-tagged SARS-CoV-2 RBD was biotinylated using the Biotin-Protein Ligase-BIRA kit according to manufacturer's instructions (Avidity) as described before (Robbiani, D. F. et al. Nature 584, 437-442 (2020)). Ovalbumin (Sigma, A5503-1G) was biotinylated using the EZ-Link Sulfo-NHS-LC-Biotinylation kit according to the manufacturer's instructions (Thermo Scientific). Biotinylated ovalbumin was conjugated to streptavidin-BV711 (BD biosciences, 563262) and RBD to streptavidin-PE (BD Biosciences, 554061) and streptavidin-AF647 (Biolegend, 405237).

Flow Cytometry and Single Cell Sorting

Single-cell sorting by flow cytometry was performed as described previously (Robbiani, D. F. et al. Nature 584, 437-442 (2020)). Briefly, peripheral blood mononuclear cells were enriched for B cells by negative selection using a pan-B-cell isolation kit according to the manufacturer's instructions (Miltenyi Biotec, 130-101-638). The enriched B cells were incubated in FACS buffer (1×PBS, 2% FCS, 1 mM EDTA) with the following anti-human antibodies (all at 1:200 dilution): anti-CD20-PECy7 (BD Biosciences, 335793), anti-CD3-APC-eFluro 780 (Invitrogen, 47-0037-41), anti-CD8-APC-eFluor 780 (Invitrogen, 47-0086-42), anti-CD16-APC-eFluor 780 (Invitrogen, 47-0168-41), anti-CD14-APC-eFluor 780 (Invitrogen, 47-0149-42), as well as Zombie NIR (BioLegend, 423105) and fluorophore-labelled RBD and ovalbumin (Ova) for 30 min on ice. Single CD3−CD8−CD14−CD16−CD20+Ova−RBD-PE+RBD-AF647+ B cells were sorted into individual wells of 96-well plates containing 4 μl of lysis buffer (0.5×PBS, 10 mM DTT, 3,000 units/ml RNasin Ribonuclease Inhibitors (Promega, N2615) per well using a FACS Aria III and FACSDiva software (Becton Dickinson) for acquisition and FlowJo for analysis. The sorted cells were frozen on dry ice, and then stored at −80° C. or immediately used for subsequent RNA reverse transcription.

Antibody Sequencing, Cloning, and Expression

Antibodies were identified and sequenced as described previously (Robbiani, D. F. et al. Nature 584, 437-442 (2020)). In brief, RNA from single cells was reverse-transcribed (SuperScript III Reverse Transcriptase, Invitrogen, 18080-044), and the cDNA was stored at −20° C. or used for subsequent amplification of the variable IGH, IGL, and IGK genes by nested PCR and Sanger sequencing. Sequence analysis was performed using MacVector. Amplicons from the first PCR reaction were used as templates for sequence- and ligation-independent cloning into antibody expression vectors. Recombinant monoclonal antibodies and Fabs were produced and purified as previously described (Robbiani, D. F. et al. Nature 584, 437-442 (2020)).

Cryo-EM Sample Preparation

Expression and purification of SARS-CoV-2 6P stabilized S trimers was conducted as previously described ((Hsieh, C. L. et al. Science 369, 1501-1505 (2020); Cohen, A. A. et al. bioRxiv, doi: 10.1101/2020.11.17.387092 (2020)). Purified Fab and S 6P trimer were incubated at a 1.1:1 molar ratio per protomer on ice for 30 minutes prior to deposition on a freshly glow-discharged 300 mesh, 1.2/1.3 Quantifoil copper grid. Immediately before 3 μl of the complex was applied to the grid, fluorinated octyl-malotiside was added to the Fab-S complex to a final detergent concentration of 0.02% w/v, resulting in a final complex concentration of 3 mg/ml. Samples were vitrified in 100% liquid ethane using a Mark IV Vitrobot after blotting for 3 s with Whatman No. 1 filter paper at 22° C. and 100% humidity.

Cryo-EM Data Collection and Processing

Data collection and processing followed a similar workflow to what has been previously described in detail (Barnes, C. O. et al. Nature 588, 682-687 (2020)). Micrographs were collected on a Talos Arctica transmission electron microscope (Thermo Fisher) operating at 200 kV for all Fab-S complexes. Data were collected using SerialEM automated data collection software (Mastronarde, D. N. J Struct Biol 152, 36-51 (2005)) and movies were recorded with a K3 camera (Gatan). For all datasets, cryo-EM movies were patch motion corrected for beam-induced motion including dose-weighting within cryoSPARC v2.15 (Punjani, A., et al. Nat Methods 14, 290-296 (2017).) after binning super resolution movies. The non-dose-weighted images were used to estimate CTF parameters using cryoSPARC implementation of the Patch CTF job. Particles were picked using Blob picker and extracted 4× binned and 2D classified. Class averages corresponding to distinct views with secondary structure features were chosen, and ab initio models were generated. 3D classes that showed features of a Fab-S complex were re-extracted, unbinned (0.869 Å/pixel), and homogenously refined with C1 symmetry. Overall resolutions were reported based on gold standard FSC calculations.

Cryo-EM Structure Modeling and Refinement

Coordinates for initial complexes were generated by docking individual chains from reference structures into cryo-EM density using UCSF Chimera (Goddard, T. D. et al. Protein Sci 27, 14-25 (2018)) (S trimer: PDB 7KXL, Fab: PDB 6XCA or 7K8P after trimming CDR3 loops and converting to a polyalanine model). Models were then refined into cryo-EM maps by rigid body and real space refinement in Phenix (Terwilliger, T. C., et al. Nat Methods 15, 905-908 (2018)) If the resolution allowed, partial CDR3 loops were built manually in Coot (Emsley, P., et al. Acta Crystallogr D Biol Crystallogr 66, 486-501(2010)) and then refined using real-space refinement in Phenix.

Computational Analyses of Antibody Sequences

Antibody sequences were trimmed based on quality and annotated using Igblastn v.1.14. with IMGT domain delineation system. Annotation was performed systematically using Change-O toolkit v.0.4.540 (Gupta, N. T. et al. Bioinformatics 31, 3356-3358 (2015)). Heavy and light chains derived from the same cell were paired, and clonotypes were assigned based on their V and J genes using in-house R and Perl scripts (Extended data FIG. 2). All scripts and the data used to process antibody sequences publicly are available on GitHub (https://github.com/stratust/igpipeline).

The frequency distributions of human V genes in anti-SARS-CoV-2 antibodies from this study were compared to 131,284,220 IgH and IgL sequences generated by and downloaded from cAb-Rep (Guo, Y., et al. Front Immunol 10, 2365 (2019).), a database of human shared BCR clonotypes available at https://cab-rep.c2b2.columbia.edu/. Based on the 97 distinct V genes that make up the 4186 analyzed sequences from Ig repertoire of the 14 participants present in this study, the IgH and IgL sequences were selected from the database that are partially coded by the same V genes and counted them according to the constant region. The frequencies shown in (FIG. 2e and Extended Data FIG. 3a) are relative to the source, and isotype analyzed. The two-sided binomial test was used to check whether the number of sequences belonging to a specific IgHV or IgLV gene in the repertoire is different according to the frequency of the same IgV gene in the database. Adjusted p-values were calculated using the false discovery rate (FDR) correction. Significant differences are denoted with stars.

Nucleotide somatic hypermutation and CDR3 length were determined using in-house R and Perl scripts. For somatic hypermutations, IGHV and IGLV nucleotide sequences were aligned against their closest germlines using Igblastn, and the number of differences were considered nucleotide mutations. The average mutations for V genes were calculated by dividing the sum of all nucleotide mutations across all participants by the number of sequences used for the analysis. To calculate the GRAVY scores of hydrophobicity (Kyte, J. & Doolittle, R. F. J Mol Biol 157, 105-132 (1982)), Guy H. R. Hydrophobicity scale was used based on free energy of transfer (kcal/mole) implemented by the R package Peptides (the Comprehensive R Archive Network repository; https://journal.r-project.org/archive/2015/RJ-2015-001/RJ-2015-001.pdf). 1405 heavy chain CDR3 amino acid sequences from this study and 22,654,256 IGH CDR3 sequences from the public database of memory B cell receptor sequences were used. The two-tailed Wilcoxon nonparametric test was used to test whether there is a difference in hydrophobicity distribution.

Data Availability Statement:

The raw sequencing data and computer scripts associated with FIG. 2 have been deposited at Github (https://github.com/stratust/igpipeline). This study also uses data from "A Public Database of Memory and Naive B-Cell Receptor Sequences" (DeWitt, W. S. et al. PLOS One 11, e0160853 (2016)), PDB (6VYB and 6NB6) and from "High frequency of shared clonotypes in human B cell receptor repertoires" (Soto, C. et al. Nature 566, 398-402 (2019)). Cryo-EM maps associated with data reported in this manuscript are deposited in the Electron Microscopy Data Bank (EMDB: https://www.ebi.ac.uk/pdbe/emdb/).

Example 2

To date, severe acute respiratory syndrome coronavirus-2 (SARS-CoV-2) has infected nearly 100 million individuals resulting in almost two million deaths. Many vaccines are being deployed to prevent the disease, including two novel mRNA-based vaccines (Gaebler, C. & Nussenzweig, M. C. Nature 586, 501-502 (2020); Krammer, F. Nature 586, 516-527 (2020)). These vaccines elicit neutralizing antibodies and appear to be safe and effective, but the precise nature of the elicited antibodies is not known. Here, the antibody and memory B cell responses in a cohort of 20 volunteers who received either the Moderna (mRNA-1273) or Pfizer-BioNTech (BNT162b2) vaccines were reported. Consistent with prior reports, 8 weeks after the second vaccine injection, the volunteers showed high levels of IgM, and IgG anti-SARS-CoV-2 spike protein (S), receptor binding domain (RBD) binding titers. Moreover, the plasma neutralizing activity and the relative numbers of RBD-specific memory B cells were equivalent to individuals who recovered from natural infection. However, activity against SARS-CoV-2 variants encoding E484K or N501Y or the K417N:E484K:N501Y combination was reduced by a small but significant margin. Consistent with this finding, vaccine-elicited monoclonal antibodies (mAbs) potently neutralize SARS-CoV-2, targeting a number of different RBD epitopes. However, neutralization by 9 of the 17 most potent mAbs tested was reduced or abolished by either K417N, E484K, or N501Y mutations. Notably, the same mutations were selected when recombinant vesicular stomatitis virus (rVSV)/SARS-CoV-2 S was cultured in the presence of the vaccine-elicited mAbs. Thus vaccine- and virus-encoded S adopts similar conformations to induce equivalent anti-RBD antibodies. Taken together, the results indicate that the antibodies in clinical 20) use should be tested against newly arising variants, and that mRNA vaccines may need to be updated periodically.

Between Oct. 19, 2020 and Jan. 15, 2021, 20 volunteers who received two doses of the Moderna (n=14) or Pfizer mRNA (n=6) vaccines were recruited for blood donation and analyzed. Ages of the analyzed volunteers ranged from 29-69 years (median 43); 12 (60%) were male and 8 (40%) female. 16 participants identified as Caucasian, 2 as Hispanic, and 1 as African American or Asian, respectively. The time from the second vaccination to sample collection varied between 3-14 weeks with an average of 8 weeks. None of the volunteers had a history of prior SARS-CoV-2 infection, and none reported serious adverse events after vaccination (Table 1).

Vaccine Plasma Binding and Neutralizing Activity Against SARS-CoV-2

Plasma IgM and IgG anti-SARS-CoV-2 S and RBD were measured by enzyme-linked immunosorbent assay (ELISA). All individuals tested showed reactivity to S and RBD that was significantly higher compared to pre-COVID-19 historic controls (FIG. 5). Anti-S and -RBD IgG levels were higher than IgM or IgA. Moreover, there was greater variability in the anti-RBD than the anti-S response, but the two were positively correlated (FIG. 5).

Plasma neutralizing activity was determined using HIV-1 pseudotyped with SARS-CoV-2 S protein. There was a broad range of plasma neutralizing activity 3-14 weeks after the second vaccine dose that was similar to that elicited by natural infection in a mild disease cohort after 1.3 months and greater than the activity at 6.2 months after infection (FIG. 1a; Table 1). There was no significant difference in neutralizing activity between Moderna and Pfizer vaccines (FIG. 1b). Plasma neutralizing activity was directly correlated to anti-S and -RBD binding titers in ELISAs (FIGS. 1c-d and FIGS. 6a-d). Finally, RBD and S binding and neutralizing activities were directly correlated to the time between receiving the first dose and blood donation with significantly lower levels in all three measurements with time (FIGS. 1e-g, and FIGS. 6e-h).

To determine whether plasma from vaccinated individuals can neutralize circulating SARS-CoV-2 variants of concern and mutants that arise in vitro under antibody pressure, w vaccinee plasma was tested against a panel of 10 mutant pseudotype viruses, including recently-reported N501Y (B1.1.7 variant), K417N, E484K and the combination of these 3 RBD mutations (501Y.V2 variant). Vaccinee plasma was significantly less effective in neutralizing the HIV-1 virus pseudotyped with certain SARS-CoV-2 mutant S proteins (FIGS. 1e and f and Extended Data FIG. 2). Among the volunteer plasmas tested, there was a 1 to 3, 1.3 to 2.5, and 1.1 to 3 fold decrease in neutralizing activity against E484K, N501Y, and the K417N:E484K:N501Y combination, respectively (p=0.008, p=0.003, and p=0.002 respectively, FIGS. 1h and i). It was concluded that the plasma neutralizing activity elicited by mRNA vaccination is variably but significantly less effective against particular RBD mutants in the tested panel.

Vaccine-Elicited SARS-CoV-2 RBD-Specific Monoclonal Antibodies

Although circulating antibodies derived from plasma cells wane over time, long-lived immune memory can persist in expanded clones of memory B cells. Flow cytometry was used to enumerate the circulating SARS-CoV-2 RBD-specific memory B cells elicited by mRNA immunization (FIG. 2a and FIGS. 7a-b). Notably, the percentage of RBD-binding memory B cells in vaccinees was significantly greater than in naturally infected individuals assayed after 1.3 months, but similar to the same individuals assayed after 6.2 months (FIG. 2b). The percentage of RBD-binding memory B cells in vaccinees was not correlated to the time after vaccination FIG. 7c). Thus, mRNA vaccination elicits a robust SARS-CoV-2 RBD-specific B cell memory response that resembles natural infection.

Figure 8A:
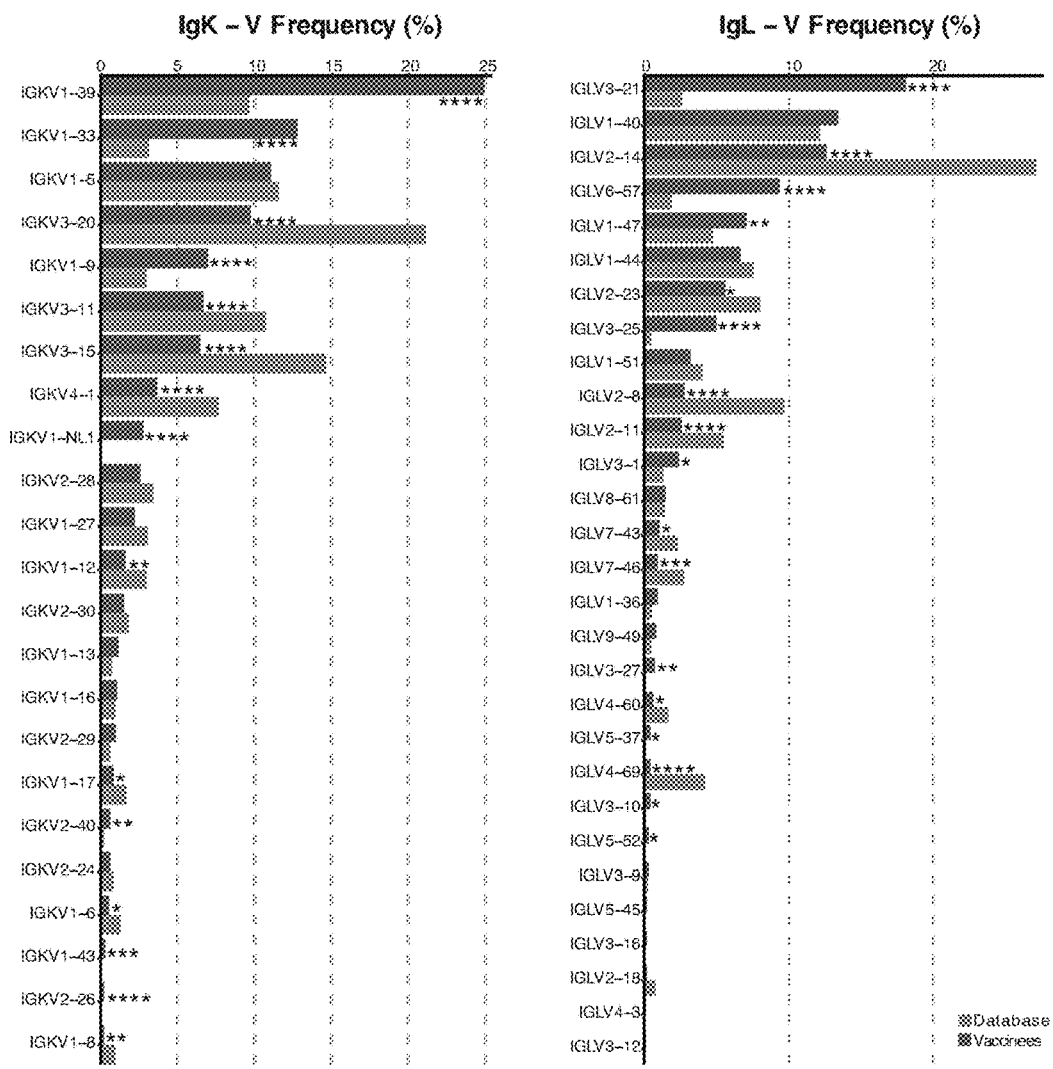
FIGS. 8a and 8b are a set of diagrams showing frequency distributions of human $V_L$ genes.
Figure 8B:
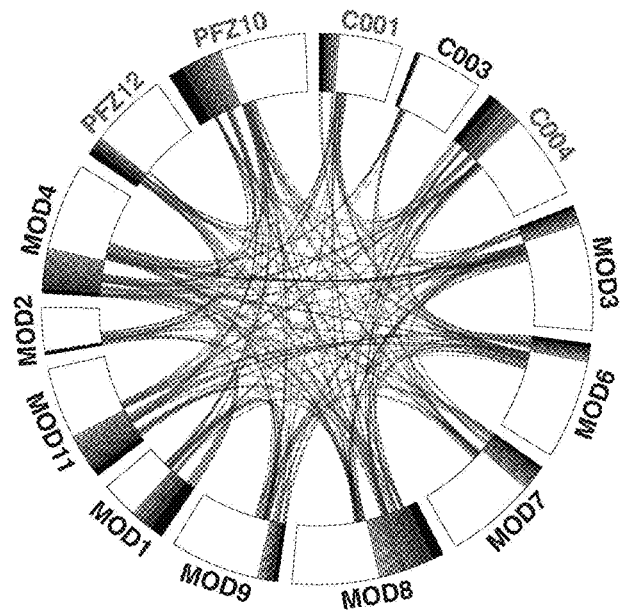
Figures 9A, 9B:
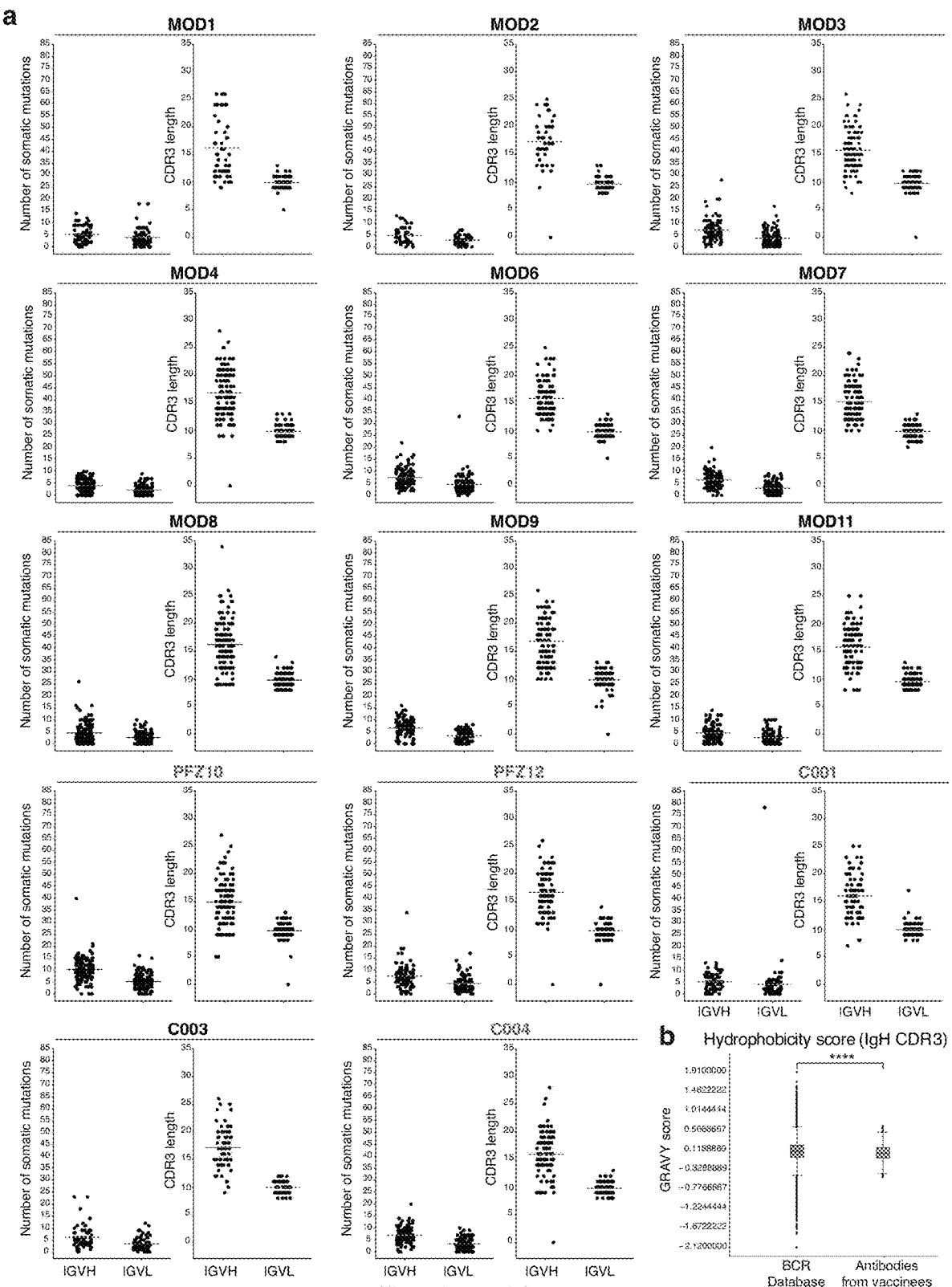
FIGS. 9a and 9b are a set of diagrams showing antibody somatic hypermutation and CDR3 length.

To examine the nature of the antibodies produced by memory B cells in response to vaccination, 1,409 paired antibody heavy and light chains were obtained from RBD binding single B cells from 14 individuals (n=10 Moderna and n=4 Pfizer vaccinees) (Table 2). Expanded clones of cells comprised 4-50% of the overall RBD binding memory B cell compartment (FIGS. 2-d and FIG. 7d). Similar to natural infection, IGVH 3-53, and 3-30 and some IGVL genes were significantly over-represented in the RBD-binding memory B cell compartment of vaccinated individuals (FIG. 2e and FIG. 8a). In addition, antibodies that share the same combination of IGHV and IGLV genes in vaccinees comprised 39% of all the clonal sequences (FIG. 8b) and 59% when combined with naturally infected individuals (FIG. 2f), and some of these antibodies were nearly identical (Tables 2 and 3). The number of V gene nucleotide mutations in vaccinees is greater than in naturally infected individuals assayed after 1.3 months, but lower than that in the same individuals assayed after 6.2 months (FIG. 2g and FIG. 9a). The length of the IgH CDR3 was similar in both naturally infected individuals and vaccinees, and hydrophobicity was below average (FIG. 2h and FIGS. 9a-b). Thus, the IgG memory response is similar in individuals receiving the Pfizer and Moderna vaccines, and both are rich in recurrent and clonally expanded antibody sequences.

Figures 10D, 10E, 10F, 10G, 10K, 10L:
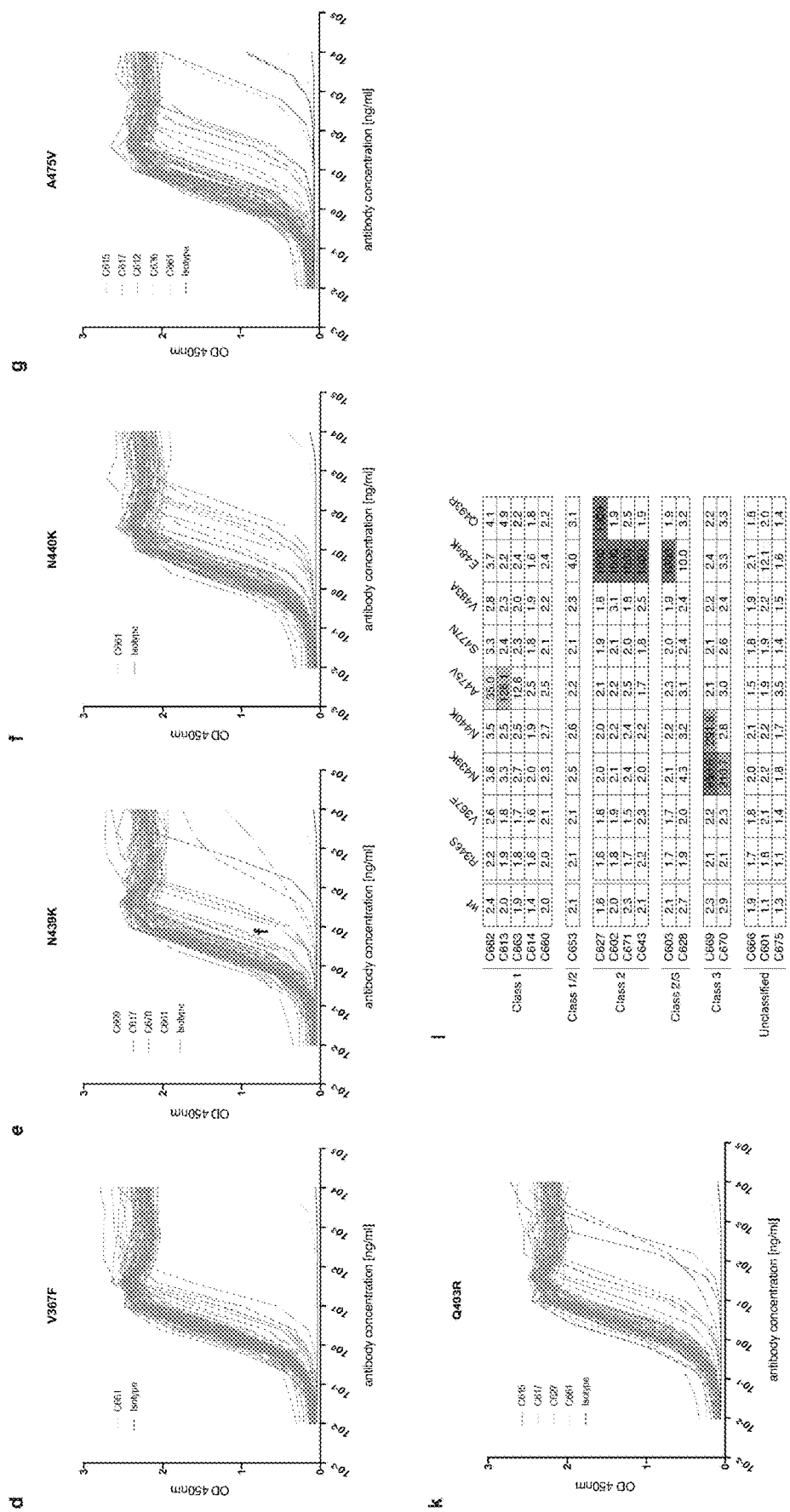

Eighty-four representative antibodies from 4 individuals were expressed and tested for reactivity to the RBD (Table 4). The antibodies included: (1) 58 that were randomly selected from those that appeared only once, and (2) 26 representatives of expanded clones. Of the antibodies tested 99% (83 out of the 84) bound to RBD, indicating that single-cell sorting by flow cytometry efficiently identified B cells producing anti-RBD antibodies (FIGS. 10a-b; Table 4). In anti-RBD ELISAs, the mean half-maximal effective concentration ($EC_{50}$) was higher than that observed in infected individuals after 6 months but not significantly different from antibodies obtained 1.3 months after infection (FIG. 6a; Table 4). To examine memory B cell antibodies for binding to circulating SARS-CoV-2 variants and antibody resistant mutants, ELISA assays were performed using mutant RBDs. Twenty-two (26%) of the antibodies showed at least 5-fold decreased binding to at least one of the mutant RBDs (FIGS. 10c-1; Table 4).

SARS-CoV-2 S pseudotyped viruses were used to measure the neutralizing activity of all 84 antibodies (FIG. 3a, Table 4). Consistent with the plasma neutralization results, the geometric mean neutralization half-maximal inhibitory concentration of the vaccinee antibodies ($IC_{50}$=151 ng/ml) was not significantly different from antibody collections obtained from naturally infected individuals 1.3 or 6.2 months after infection (FIG. 3a).

To examine the neutralizing breadth of the monoclonal antibodies and begin to map their target epitopes, the 17 most potent antibodies were tested, 8 of which carried IgHV3-53, against a panel of 12 SARS-CoV-2 variants: A475V is resistant to class 1 antibodies (structurally defined as described (Barnes, C. O. et al. Nature 588, 682-687 (2020)); E484K and Q493R are resistant to class 2 antibodies; while R346S, N439K, and N440K are resistant to class 3 antibodies. Additionally, K417N, Y453F, S477R, N501Y, D614G, and R683G represent circulating variants some of which have been associated with rapidly increasing case numbers. Based on their neutralizing activity against the variants, all but 3 of the antibodies were provisionally assigned to a defined antibody class or a combination (FIG. 3b). As seen in natural infection, a majority of the antibodies tested (9/17) were at least ten-fold less effective against pseudotyped viruses carrying the E484K mutation. In addition, 5 of the antibodies were less potent against K417N and 4 against N501Y by ten-fold or more (FIG. 3b).

To determine whether antibody-imposed selection pressure could also drive the emergence of resistance mutations in vitro, an rVSV/SARS-CoV-2 recombinant virus was cultured in the presence of each of 18 neutralizing monoclonal antibodies. All of the tested antibodies were selected for RBD mutations. Moreover, in all cases, the selected mutations corresponded to residues in the binding sites of their presumptive antibody class (FIG. 3c). For example, antibody 627, which was assigned to class 2 based on sensitivity to E484K mutation, was selected for the emergence of the E484K mutation in vitro (FIGS. 3b and c). Notably, 6 of the antibodies selected for K417N E or T, 5 selected for E484K and three selected for N501Y, T, or H, which coincide with mutations present in the circulating B1.1.17, 501Y. V2 and B1.1.28/501.V3 variants that have been associated with rapidly increasing case numbers in particular locales.

Antibody Epitopes

Cryo-EM Mapping of Antibody Epitopes

To further characterize antibody epitopes and mechanisms of neutralization, seven complexes between mAb Fab fragments and the prefusion, stabilized ectodomain trimer of SARS-CoV-2 S glycoprotein were characterized (Hsieh et al. Science: Vol. 369, Issue 6510, pp. 1501-1505 (2020)) using single-particle cryo-EM (FIG. 4). Fab-S complexes exhibited multiple RBD-binding orientations recognizing either 'up'/'down' (FIGS. 4a-j) or solely 'up' (FIGS. 4k-n) RBD conformations, consistent with structurally defined antibody classes from natural infection. The majority of mAbs characterized (6/7) recognized epitopes that included RBD residues involved in ACE2 recognition, suggesting a neutralization mechanism that directly blocks ACE2-RBD interactions. Additionally, structurally defined antibody epitopes were consistent with RBD positions that were selected in rVSV/SARS-CoV-2 recombinant virus outgrowth experiments, including K417, N439/N440, E484, and N501 (FIG. 3c and FIGS. 4f-j, 4m-n). Taken together, these data indicate that functionally similar antibodies are raised during vaccination and natural infection, and that the RBDs of spike trimers translated from the mRNA delivered by vaccination adopt a similar distribution of 'up'/'down' conformations as observed on SARS-CoV-2 virions.

Discussion

The mRNA-based SARS-CoV-2 vaccines are safe and effective and are being deployed globally to prevent infection and disease. The vaccine elicits antibody responses against the RBD, the major target of neutralizing antibodies in a manner that resembles natural infection. Notably, the neutralizing antibodies produced by mRNA vaccination target the same epitopes as natural infection. The data is consistent with SARS-CoV-2 spike trimers translated from the injected RNA adopting the range of conformations available to spikes on the surfaces of virions. Moreover, different individuals immunized with either the Moderna (mRNA-1273) or Pfizer-BioNTech (BNT162b2) vaccines produce closely related and nearly-identical antibodies.

Human neutralizing monoclonal antibodies to the SARS-CoV-2 RBD can be categorized as belonging to 4 different classes based on their target regions on the RBD. Class 1 and 2 antibodies are among the most potent and also the most abundant antibodies. These antibodies target epitopes that overlap or are closely associated with RBD residues K417, E484, and N501. They are frequently sensitive to mutations in these residues and select for K417N, E484K, and N501Y mutations in both yeast and VSV expressing SARS-CoV-2 S proteins. To avert selection and escape, antibody therapies should be composed of combinations of antibodies that target non-overlapping epitopes.

A number of circulating SARS-CoV-2 variants have been associated with rapidly increasing case numbers and have particular prevalence in the UK (B1.1.7/501Y.V1) and South Africa (501Y.V2), and Brazil (B1.1.28/501.V3). The experiments indicate that these variants, and potentially others that carry K417N/T, E484K, and N501Y mutations, can reduce the neutralization potency of vaccinee plasma. The comparatively modest effects of the mutations on viral sensitivity to plasma reflect the polyclonal nature of the neutralizing antibodies in vaccinee plasma. Nevertheless, emergence of these particular variants is consistent with the dominance of class 1 and 2 antibody response in infected or vaccinated individuals and raises the possibility that they emerged in response to immune selection in individuals with suboptimal immunity. The data indicate that SARS-CoV-2 vaccines may need to be updated and immunity monitored in order to compensate for viral evolution.

Lengthy table referenced here

US12060411-20240813-T00001

Please refer to the end of the specification for access instructions.

Lengthy table referenced here

US12060411-20240813-T00002

Please refer to the end of the specification for access instructions.

Lengthy table referenced here

US12060411-20240813-T00003

Please refer to the end of the specification for access instructions.

Lengthy table referenced here

US12060411-20240813-T00004

Please refer to the end of the specification for access instructions.

Lengthy table referenced here

US12060411-20240813-T00005

Please refer to the end of the specification for access instructions.

Lengthy table referenced here

US12060411-20240813-T00006

Please refer to the end of the specification for access instructions.

Lengthy table referenced here
US12060411-20240813-T00007

Please refer to the end of the specification for access instructions.

Lengthy table referenced here
US12060411-20240813-T00008

Please refer to the end of the specification for access instructions.

Lengthy table referenced here
US12060411-20240813-T00009

Please refer to the end of the specification for access instructions.

Lengthy table referenced here
US12060411-20240813-T00010

Please refer to the end of the specification for access instructions.

Lengthy table referenced here
US12060411-20240813-T00011

Please refer to the end of the specification for access instructions.

Lengthy table referenced here
US12060411-20240813-T00012

Please refer to the end of the specification for access instructions.

Lengthy table referenced here
US12060411-20240813-T00013

Please refer to the end of the specification for access instructions.

Lengthy table referenced here
US12060411-20240813-T00014

Please refer to the end of the specification for access instructions.

Lengthy table referenced here
US12060411-20240813-T00015

Please refer to the end of the specification for access instructions.

Lengthy table referenced here
US12060411-20240813-T00016

Please refer to the end of the specification for access instructions.

Lengthy table referenced here
US12060411-20240813-T00017

Please refer to the end of the specification for access instructions.

Lengthy table referenced here
US12060411-20240813-T00018

Please refer to the end of the specification for access instructions.

The foregoing examples and description of the preferred embodiments should be taken as illustrating, rather than as limiting the present invention as defined by the claims. As will be readily appreciated, numerous variations and combinations of the features set forth above can be utilized without departing from the present invention as set forth in the claims. Such variations are not regarded as a departure from the scope of the invention, and all such variations are intended to be included within the scope of the following claims. All references cited herein are incorporated by reference in their entireties.

LENGTHY TABLES

The patent contains a lengthy table section. A copy of the table is available in electronic form from the USPTO web site (https://seqdata.uspto.gov/?pageRequest=docDetail&DocID=US12060411B2). An electronic copy of the table will also be available from the USPTO upon request and payment of the fee set forth in 37 CFR 1.19(b)(3).

SEQUENCE LISTING (5993 sequences)

SEQ ID NO: 1 - protein, 130 aa, Artificial Sequence
  Synthetic
QVQLQESGPGLVKPSETLSLTCTVSGGSINSYYWNWIRQPPGRGLEWIAYIFYSGGTNYNPSLKSRVTISVDTSKNQFSLKLSSVTAADTAVYFCARAAGVRSVLAAASSYYYYYGLDVWGQGTTVTVSS

SEQ ID NO: 2 - protein, 109 aa, Artificial Sequence
  Synthetic
QSALTQPASVSGSPGQSITISCTGTSSDVGGYNYVSWYQQHPGKAPKLMIYDVSNRPSGVSNRFSGAKSGNTASLTISGLQAEDEADYYCSSYTSSGWVFGGGTKLTVL

SEQ ID NO: 3 - protein, 121 aa, Artificial Sequence
  Synthetic
QVQLVESGGGLVEPGRSLRLSCTGSGFTFGDYVLSWVRQAPGKGLEWVGFIRSKAYGETTEHAASVKGRFTISRDDSKSIAYLQMSSLKTEDTAVYFCARGLRPTRKADYWGQGTLVTVSS

SEQ ID NO: 4 - protein, 111 aa, Artificial Sequence
  Synthetic
QSALTQPASVSGSPGQSITISCTGTRSDVGGYNSVSWYRQHPNKAPKLMIYDVSNRPSGVSNRFSGSKSGNTASLTISGLQAEDEADYYCTSYTSSTTLDVFGTGTKVTVL

SEQ ID NO: 5 - protein, 133 aa, Artificial Sequence
  Synthetic
QVQLVQSGAEVKKPGSSVKVSCKASGGTFSSYAINWVRQAPGQGLEWMGGIIPIFRTANYAQKFQGRVTITADESTRTVYMELSSLRSEDTAMYYCARGGEEGIAVAAKGWTEQNYENWFDPWGQGTLVTVSS

SEQ ID NO: 6 - protein, 113 aa, Artificial Sequence
  Synthetic
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYHSTPLTFGGGTKVEIK

SEQ ID NO: 7 - protein, 125 aa, Artificial Sequence
  Synthetic
QVQLVQSGAEVKRPGASVKVSCKASGYTFTSYYMHWVRQAPGQGLEWMGIINPSGSSTSYAQKFQGRVTLTRDTSTSTVYMELSSLRPEDTAVYYCASGYCSSGSCHAGDAFDIWGQGTMVTVSS

SEQ ID NO: 8 - protein, 107 aa, Artificial Sequence
  Synthetic
DIQMTQSPSSLSASVGDRVTITCRASQSMSNYLNWYQQKPGKAPKLLIYAASSLQSGVPARFSGSGSGTDFTLTISSLQPEDFATYYCQQSYSTPPTFGGGTKVEIK

SEQ ID NO: 9 - protein, 120 aa, Artificial Sequence
  Synthetic
QLQLQESGPGLVKPSETLSLTCTVSGASVSSSTYYWVWIRRPPGKGLEWIGTIYYSGSTYYSPSLKSRLTISVDTSKNQFSLRLSSVTAADTAIYYCAQSTWLRGSFDYWGQGTLVTVSS

SEQ ID NO: 10 - protein, 111 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSTNHWVFGGGTKLTVL

SEQ ID NO: 11 - protein, 117 aa, Artificial Sequence
  Synthetic
QVQLQESGPGLVKPSGTLSLTCAVSGGSISSNDWWNWVRQPPGKGLEWIGEIYHSGSTNYNPSLKSRVIISVDKSKNQFALNLSSVTAADTAIYYCARNCAWGSCDWGQGTLVTVSS

SEQ ID NO: 12 - protein, 110 aa, Artificial Sequence
  Synthetic
QAVVTQEPAFSVSPGGTVTLTCGLSSGSVSTSHHPCWYQQTPGQAPRTLIYDTDARSSGVPDRFSGSILGDKAALTITGAQADDESDYYCALYMGSGSWVFGGGTKLTVL

SEQ ID NO: 13 - protein, 119 aa, Artificial Sequence
  Synthetic
QVQLVQSGAEVKKPGASVKVSCKASGYTFTTYGISWVRQAPGQGLEWMGWISAYNGNTKYAQKLQGRVTMTTDTSTSTAYMELRSLRSDDTAVYYCARGIAALFGFDYWGQGTLVTVSS

SEQ ID NO: 14 - protein, 112 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNEGVVFGGGTKLTVL

SEQ ID NO: 15 - protein, 120 aa, Artificial Sequence
  Synthetic
QVQLVQSGAEVKKPGASVKVSCKASGYTFTMYHMHWVRQAPGQGLEWMGIINPSGGSTRYAQQLQGRVSMTRDTSTSTVYMELSSLRSEDTAFYYCAREDVGGTGYFDYWGQGTLVTVSS

SEQ ID NO: 16 - protein, 109 aa, Artificial Sequence
  Synthetic
SYELTQPPSVSVAPGQTARITCGANNIGSKSVHWYQQKPGQAPVLVVYDDSDRPSGIPERFSGSNSGNTATLTISRVEAGDEADYYCQVWDGSSDHFYVFGTGTTVTVL

SEQ ID NO: 17 - protein, 127 aa, Artificial Sequence
  Synthetic
EVQLVESGAEVKKPGSSVKVSCKASGGTFSSYAISWVRQAPGQGLEWMGRIIPILGIANYAQKFQGRVTITADKSTSTDYMELSSLRSEDTAVYYCAREGSAHYDSSGLNAEYFQHWGQGTTVTVSS

SEQ ID NO: 18 - protein, 111 aa, Artificial Sequence
  Synthetic
QSVLTQPPSVSGAPGQRVTISCTGSSSNIGAGYDVHWYQQLPGTAPKLLIYGNTNRPSGVPDRISGSKSGTSASLAISGLQAEDEADYYCQSYDSSLIASLFGGGTKLTVL

SEQ ID NO: 19 - protein, 119 aa, Artificial Sequence
  Synthetic
EVQLVESGAEVKKPGASVKVSCKASGYSFTSYDINWVRQATGQGLEWMGWMNPNSGNRGYAQKFQGRVTMTRNTSISTAYMELSGLTSEDTAVYFCARGVGLTYYFDYWGQGTTVTVSS

SEQ ID NO: 20 - protein, 108 aa, Artificial Sequence
  Synthetic
SYELTQPPSVSVAPGQTARITCGGNSIGSKSVHWYHQKPGQAPVLVVYDDSDRPSGIPERFSGSNSGNTATLTISRVEAGDEADYYCQVWDSSTDPVVFGGGTKLTVL

SEQ ID NO: 21 - protein, 118 aa, Artificial Sequence
  Synthetic
EVQLVESGGGLIQPGGSLRLSCAASGFTVSSNYMSWVRQAPGKGLEWVSVIYSGGSTYYADSVKGRFNISRDNSKNTLYLQMNSLRAEDTAVYYCARDLEAAGGMDVWGQGTTVTVSS

SEQ ID NO: 22 - protein, 107 aa, Artificial Sequence
  Synthetic
HIQLTQSPSFLSASVGDRVTITCRASQGISSYLAWYQQKPGKAPKLLIYAASTLQSGVPSRFSGSGSGTEFTLTISSLQPEDFATYYCQQLNGYPLTFGGGTKVEIK

SEQ ID NO: 23 - protein, 117 aa, Artificial Sequence
  Synthetic
EVQLVESGGGLIQPGGSLRLSCAASGLTVSSNYMSWVRQAPGKGLEWVSVIYSGGSTYYADSVKGRFTISRDNSKNTLFLEMNSLRAEDTAVYYCARDLDYYGMDVWGQGTTVTVSS

SEQ ID NO: 24 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQLLNSYPRLTFGGGTKVEIK

SEQ ID NO: 25 - protein, 117 aa, Artificial Sequence
  Synthetic
EVQLVESGGGLIQPGGSLRLSCAATGFIVSSNYMSWVRQAPGKGLEWVSVIYSGGSTFYAESVKGRFTISRDNSKNTLYLQMNSLRAEDTAVYYCARDWGEYYFDYWGQGTLVTVSS

SEQ ID NO: 26 - protein, 108 aa, Artificial Sequence
  Synthetic
EIVLTQSPGTLSLSPGERATLSCRASQIVSSSYLAWYQQKPGQAPRLLIYGASSRATGIPDRFSGSGSGTDFTLTISGLEPEDFAVYYCQQYDSSPRTFGQGTKVEIK

SEQ ID NO: 27 - protein, 120 aa, Artificial Sequence
  Synthetic
EVQLVESGGGLIQPGGSLRLSCAASGFTVSSNYMSWVRQAPGKGLEWVSTIYSGGSTYYADSVKGRFTISRDNSKNTLYLQMNSLRAEDTAVYYCARDHVAAMVQGQGVWGQGTTVTVSS

SEQ ID NO: 28 - protein, 107 aa, Artificial Sequence
  Synthetic
DIQMTQSPSSLSASVGDRVTITCQASQDITNYLNWYQQKPGKAPKLLIYDASNLETGVPSRFSGSGSGTDFTFTISSLQPEDIATYYCQQYDNLPLTFGGGTKVEIK

SEQ ID NO: 29 - protein, 117 aa, Artificial Sequence
  Synthetic
EVQLVESGGGLIQPGGSLRLSCAASGILVSSNYMNWVRQAPGMGLEWVSVIYSGGSTFYADSVKGRFTISRDNSKNTLYLQMNSLRAEDTAMYYCARDLGVSGMDVWGQGTTVTVSS

SEQ ID NO: 30 - protein, 106 aa, Artificial Sequence
  Synthetic
DIQLTQSPSFLSASVGDRVTITCRASQGISSYLAWYQQKPGKAPKLLIYAASTLQNGVPSRFSGSGSGTEFTLTISSLQPEDFATYYCQHLNSYSLFGPGTKVDIK

SEQ ID NO: 31 - protein, 117 aa, Artificial Sequence
  Synthetic
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDRGGALHDYWGQGTLVTVSS

SEQ ID NO: 32 - protein, 110 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPEGIFTFGPGTKVDIK

SEQ ID NO: 33 - protein, 122 aa, Artificial Sequence
  Synthetic
EVQLLESGGGLVQPGGSLRLSCAASGFTFSSYAMSWVRQAPGKGLEWVSAISGSGGGTYYADSVKGRFTISRDNSKNTLYLQMNSLRADDTAVYYCAKDLNALQHVETFDPWGQGTLVTVSS

SEQ ID NO: 34 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTLPYTFGQGTKLEIK

SEQ ID NO: 35 - protein, 124 aa, Artificial Sequence
  Synthetic
QVQLVESGGGVVQPGRSLRLSCAVSGFTFSIYGMHWVRQAPGKGLEWVAVISYDGDNKYSADSVKGRFTISRDNSKNTLYLQMNSLRAEDTAVYYCAKGSYYDILTGYYGLDYWGQGTLVTVSS

SEQ ID NO: 36 - protein, 112 aa, Artificial Sequence
  Synthetic
DIVMTQSPLSLPVTPGEPASISCTSSQSLLYSNGYNYLDWYLQKPGQSPQLLIYLGSNRASGVPDRFSGSGSGTDFTLKISRVEAEDVGVYYCMQALQTPYTFGQGTKLEIK

SEQ ID NO: 37 - protein, 128 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDSHYYYYDSSGYYGSIPDYWGQGTLVTVSS

SEQ ID NO: 38 - protein, 113 aa, Artificial Sequence
  Synthetic
DIVMTQSPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPHSAFGPGTKVDIK

SEQ ID NO: 39 - protein, 124 aa, Artificial Sequence
  Synthetic
EVQLVESGGGLVQPGGSLRLSCAASGLTFSSYSMNWVRQAPGKGLEWVSYISSSSSTIYYADSVKGRFTISRDNAKNSLYLQMNSLRDEDTAVYYCARVGARITGTSTYYFDYWGQGTLVTVSS

SEQ ID NO: 40 - protein, 109 aa, Artificial Sequence
  Synthetic
EIVLTQSPATLSLSPGERATLSCRASQSVSSYLAWFQHKPGQAPRLLIYDASNRATGIPARFSGSGSGTDFTLTISSLEPEDFAVYYCQQRSTWPRGFTFGPGTKVDIK

SEQ ID NO: 41 - protein, 122 aa, Artificial Sequence
  Synthetic
EVQLVESGGGLVQPGGSLRLSCAASGFTFSTYDMHWVRQATGKGLEWVSTIGTAGDTYYLGSVKGRFTISRENAKNSLYLQMNSLRAGDTAVYYCARARGGTAMAPYYFDYWGQGTLVTVSS

SEQ ID NO: 42 - protein, 108 aa, Artificial Sequence
  Synthetic
DIQMTQSPSSLSASVGDRVTISCRASQSISNFLNWYQQKPGKAPKLLIYAASSLQSGVPSRFSGSGSGTDFTLTISSLQPEDFATYYCQQSYITPHLTFGGGTKVEIK

SEQ ID NO: 43 - protein, 132 aa, Artificial Sequence
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVFYCAIERYCTNGVCSAPGPSYYYYAMDVWGQGTTVTVSS

SEQ ID NO: 44 - protein, 106 aa, Artificial Sequence
  Synthetic
DIQMTQSPSSLSASVGDRVTITCQASQDISNYLNWYQHKPGKAPKLLIYDASNLETGVPSRFSGSGSGTDFTFTISSLQPEDIATYYCQQYDNLPLFGPGTKVDIK

SEQ ID NO: 45 - protein, 124 aa, Artificial Sequence
  Synthetic
QVQLVQSGAEVKKPGSSVKVSCKASGGTFSSYAITWVRQAPGQGLECMGRIIPILGIAYYAQKFQGRVTITADQSTSTAYMELSSLRSEDTAVYYCAREFAVVPVASTWWFDPWGQGTLVTVSS

SEQ ID NO: 46 - protein, 111 aa, Artificial Sequence
  Synthetic
QSVLTQPPSVSGAPGQRVTISCTGTSSNIGAGYDVHWYQQLPGTAPKLLIYGNSNRPSGVPDRFSGSKSGTSASLAITGLQADDEADYYCQSYDSSLSGSVFGVGTKLTVL

SEQ ID NO: 47 - protein, 122 aa, Artificial Sequence
  Synthetic
QVQLVQSGAEVKKPGASVKVSCKASGYTFTSYDINWVRQATGQGLEWMGWMNPNSGNTAYAQKFQGRVTMTRNTSVSTAYMELSSLRSEDTAVYYCARATRSGSYSFVMDVWGQGTTVTVSS

SEQ ID NO: 48 - protein, 110 aa, Artificial Sequence
  Synthetic
SYELTQPPSVSVAPGQTARITCGGNNIGSKNVHWYQQKPGQAPVLVVYDDSDRPSGIPERFSGSNSGNTATLTISRVEAGDEADYYCQVWDSSSDHPLVVFGGGTKLTVL

SEQ ID NO: 49 - protein, 127 aa, Artificial Sequence
  Synthetic
QVQLVESGGGLVKPGGSLRLSCAASGFTFSDYYMTWIRQAPGKGLEWVSYITSTSSFTNYADSVRGRFTISRDYAKNSLYLQMTSLRAEDTAVYYCARVFLRSAYPSSRVVWAFDIWGQGTMVTVSS

SEQ ID NO: 50 - protein, 106 aa, Artificial Sequence
  Synthetic
DIQMTQSPSSLSASVGDRVTITCQASQDISNYLNWYQQKPGKAPKLLIYDASNLETGVPSRFSGSGSGTDFTFIISSLQPEDIATYYCQQYDLGVTFGPGTKVDIK

SEQ ID NO: 51 - protein, 128 aa, Artificial Sequence
  Synthetic
QVQLVESGGGLVKPGGSLRLSCAASGFTFSDYYMSWIRQAPGKGLEWVSYISVSSSYTNYADSVKGRFTISRDNAKNSLYLQMNSLRAEDTAVYYCARGGYCTSTSCYKGFPNWFDPWGQGTLVTVSS

SEQ ID NO: 52 - protein, 107 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 53 - protein, 119 aa, Artificial Sequence
  Synthetic
EVQLVESGGGLVQPGGSLRLSCAASGFTFSSYDMHWVRQATGKGLEWVSAIGTAGDTYYPGSVKGRFIISRENAKNSLYLQMNSLRAGDTAVYYCARGGRWLQTVFDLWGRGTLVTVSS

SEQ ID NO: 54 - protein, 108 aa, Artificial Sequence
  Synthetic
DIQMTQSPSSLSASVGDRVTITCRASQSISSYLNWYQQKPGKAPNLLIFAASSLQSGVPSRFSGSGSGTDFTLTISRLQPEDFATYYCQQSYSMPPVTFGPGTKVDIK

SEQ ID NO: 55 - protein, 125 aa, Artificial Sequence
  Synthetic
EVQLLESGGGLVQPGGSLRLSCAASGFTFSSYAMSWVRQAPGKGLEWVSAIVGSGGSTYYADSVKGRFTISRDNSKNTAYLQMNSLRAEDTAVYYCAKDVMVWSGSYLPEYFQHWGQGTLVTVSS

SEQ ID NO: 56 - protein, 105 aa, Artificial Sequence
  Synthetic
SYELTQPPSVSVSPGQTASITCSGHKLGDKYACWYQQKPGQSPVLVIYQDNKRPSGIPERFSGSNSGNTATLTISGTQAMDEADYYCQSWDSSVVFGGGTKLTVL

SEQ ID NO: 57 - protein, 122 aa, Artificial Sequence
  Synthetic
EVQLLESGGGLVQPGGSLRLSCAASGITFSRHAMSWVRQAPGKGLEWVSVISGSGGSTYYADSVKGRFTISRDNSKNTLYLQMNSLRAEDTAVYYCAKDRYAGPYSSSSDYWGQGTLVTVSS

SEQ ID NO: 58 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPVTFGGGTKVEIK

SEQ ID NO: 59 - protein, 125 aa, Artificial Sequence
  Synthetic
QVQLVESGGGVVQPGRSLRLSCAASGFTFSSYGMHWVRQAPGKGLEWVAVISYDGSNEYYADSVKGRFTISRDNSKNTLYLQMNSLRAEDTAVYYCAKVNSQYSSDWYDRAFDYWGQGTLVTVSS

SEQ ID NO: 60 - protein, 106 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIK

SEQ ID NO: 61 - protein, 127 aa, Artificial Sequence
  Synthetic
QVQLVESGGGVVQPGRSLRLSCAASGFTFSNYGMHWVRQAPGKGLEWVAIIWNDGSNKYYADSVKGRFTISRDISRNTLYLQMNSLRAEDTAVYYCARSQYYYDRSGYANHDAFDIWGQGTMVTVSS

SEQ ID NO: 62 - protein, 108 aa, Artificial Sequence
  Synthetic
DIQMTQSPSTLSASVGDRVTITCRASQSISSWLAWYQQKPGKAPKLLIYEASSLESGVPSRFSGSGSGTEFTLTISSLQPDDFATYYCQQYNSYLTWTFGQGTKVEIK

SEQ ID NO: 63 - protein, 123 aa, Artificial Sequence
  Synthetic
EVQLVESGGGLVQPGGSLRLSCAASGFTFTTYNMNWVRQAPGKGLEWVSYISDSGGTIYYADSVKGRFTISRDNAKNSLYLQMNSLRDEDTAVYYCARVKGRSSYYYYGMDVWGQGTTVTVSS

SEQ ID NO: 64 - protein, 107 aa, Artificial Sequence
  Synthetic
DIQMTQSPSSLSASVGDRVTITCRASQNIYIYLNWYQQKPGKAPKVLIYGASSLQSGVPSRFSGSGSGTDFTLTISSLQPEDCATYYCQQSYSTPVTFGPGTKVDIK

SEQ ID NO: 65 - protein, 115 aa, Artificial Sequence
  Synthetic
EVQLVESGGGLIQPGGSLRLSCAASGFTVSSNYMNWVRQAPGKGLEWVSVIYSGGSTYYADSVKGRFTISRDNSKNTLYLQMNSLRAEDTAVYYCARVVPGNEDWGQGTLVTVSS

SEQ ID NO: 66 - protein, 108 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPEGTFGGGTKVEIK

SEQ ID NO: 67 - protein, 118 aa, Artificial Sequence
  Synthetic
EVQLVESGGGLIQPGGSLRLSCAASGVTVRSNYMSWVRQAPGKGLEWVSVIYSGGSTFYADSVKGRFTISRDNSKNTLYLQMNSLRAEDTAVYYCARGGGHYYGMDVWGQGTTVTVSS

SEQ ID NO: 68 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIK

SEQ ID NO: 69 - protein, 125 aa, Artificial Sequence
  Synthetic
EVQLVESGGGLVQPGGSLRLSCAASGFTFSSYAMHWVRQAPGKGLQYVSAISSNGGSTYYANSVKGRFTISRDNSKNTLYLQMGSLRAEDMAVYYCARDGCSSTSCPEINWFDPWGQGTLVTVSS

SEQ ID NO: 70 - protein, 108 aa, Artificial Sequence
  Synthetic
SYELTQPPSVSVAPGQTARITCGGNNIGSKSVHWYQQKPGQAPVLVVYDDSDRPSGIPERFSGSNSGNTATLTISRVEAGDEADYYCQVWDGSSDHVVFGGGTKLTVL

SEQ ID NO: 71 - protein, 125 aa, Artificial Sequence
  Synthetic
QLQLQESGPGLVKPSETLSLTCTVSGGSISSSSYYWGWIRQPPGKGLEWIGNIYYSGITYYNPSLKSRVTISVDTSKSQFSLNLSSVTAADTAVYYCARRGRVYGGNSGNAFDIWGQGTMVTVSS

SEQ ID NO: 72 - protein, 108 aa, Artificial Sequence
  Synthetic
QSALTQPASVSGSPGQSITISCTGTSSDVGSYDLVSWYQQHPGKSPKLMIYEVIKRPSGVSNRFSGSKSGNTASLTISGLQAEDEADYYCCSYAGSWVFGGGTKLTVL

SEQ ID NO: 73 - protein, 119 aa, Artificial Sequence
  Synthetic
QVQLQESGPGLVKPSETLSLTCTVSGDSISRYYWSWIRQPPGKGLEWIGYSHYSGSTNYNPSLKSRVSLSLDTSKNHLSLKLSSVTAADTAVYYCARAHYYVTSDFDYWGQGTLVTVSS

SEQ ID NO: 74 - protein, 111 aa, Artificial Sequence
  Synthetic
QSVLTQPPSASGTPGQRVTIACSGSSSNIGSNSVNWFQQLPGTAPKLLIYSDNQRPSGVPDRFSGSKSGTSASLAISGLQSEDEADYYCAAWDDSLNGHVVFGGGTKLTVL

SEQ ID NO: 75 - protein, 120 aa, Artificial Sequence
  Synthetic
QVQLVQSGAEVKKPGASVKVSCKASGYTFTSYYIHWVRQAPGQGLEWMGIIYPSGGSRRYAQKFQGRVTMTRDTSTSTVNMELNSLRSEDTAVYYCAREGSTGTTFLDYWGQGTLVTVSS

SEQ ID NO: 76 - protein, 109 aa, Artificial Sequence
  Synthetic
SYELTQPPSVSVAPGQTARITCGGNNIGSKSVHWYQQKPGQAPVLVVYDDSDRPSGIPERFSGSNSGNTATLTISRVEAGDEADYYCHVWDGSSDHHVVFGGGTKLTVL

SEQ ID NO: 77 - protein, 125 aa, Artificial Sequence
  Synthetic
QVQLVQSGAEVKKPGSSVKVSCKASGGSFSNYAISWVRQAPGQGLEWMGGIIPFSGTANYAQKFQGRVTITADEATSTAYMELSSLRSEDTAVYYCARDDYGTLWAHYYYGMVVWGQGTTVTVSS

SEQ ID NO: 78 - protein, 109 aa, Artificial Sequence
  Synthetic
QAVVTQEPSFSVSPGGTVTLTCGLSSGSVSTSYYPSWFQQTPGQAPRTLIYSTNTRSSGVPDRFSGSVLGNKAALTITGAQSDDESDYYCVLYMGSGKVVFGGGTKLTV

SEQ ID NO: 79 - protein, 126 aa, Artificial Sequence
  Synthetic
EVQLLESGGGLVQPGGSLRLSCAASGFAFITYAMTWVRQAPGKGLEWVSIISASGGSTYYADSVKGRFTISRDNSENTLYLQMSSLRAEDTAVYFCAKVTFRTELTQVVPNYFDFWGQGTLVTVSS

SEQ ID NO: 80 - protein, 107 aa, Artificial Sequence
  Synthetic
EIVLTQSPATLSLSPGERATLSCRASQSVNTYLAWYQQKPGQAPRLLIYDASNRATGIPARFSGSGSGTGFTLTISSLEPEDFAVYYCQQRTNWPLTFGGGTKVEIK

SEQ ID NO: 81 - protein, 120 aa, Artificial Sequence
  Synthetic
QVQLVESGGGVVQPGRSLRLSCAASGFTFSTYAMHWVRQAPGKGLEWVAVILYDGSYKSYADSVKGRFTISRDNSKSTLYLHMNSLRAEDTAVYYCATDEGEATTYPGYWGQGTLVTVSS

SEQ ID NO: 82 - protein, 108 aa, Artificial Sequence
  Synthetic
DIQMTQSPSSLSASVGDRVTITCRASQSISRYLNWYQQKPGKAPNLLIYAASNLQSGVPSRFSGSGSGTDFTLTISSLQPEDFATYYCQQSYSTPPWTFGQGTKVEIK

SEQ ID NO: 83 - protein, 127 aa, Artificial Sequence
  Synthetic
QVQLVESGGGVVQPGRSLRLSCAASGFTFSSYGMHWVRQAPGKGLEWVAVISSDASNTYFADSVKGRLTISRDNSKNILFLQMNSLRTEDTAVYYCAKSHSTAYSPSTFYYYGLDVWGQGTTVTVSS

SEQ ID NO: 84 - protein, 108 aa, Artificial Sequence
  Synthetic
DIQMTQSPSSLSASVGDRVTITCRASQSIDSYLNWYQQKPGKAPKLLIYAASSLQSGVPSRFSGSGSGTDFTLTISSLQPEDFATYFCQQSYSTPPFTFGPGTKVDIK

SEQ ID NO: 85 - protein, 127 aa, Artificial Sequence
  Synthetic
EVQLVESGGGLVKPGRSLRLSCTTSGFTFGDYTMSWFRQAPGKGLEWVGFIRTEAFGGTTEYAASVKGRFTISRDDSKSIAFLQMNSLKTEDTAVYYCTRRIMYYSDNSGSRTFDYWGQGTLVTVSS

SEQ ID NO: 86 - protein, 106 aa, Artificial Sequence
  Synthetic
EIVMTQSPATLSVSPGESVTLSCRASQSVSSNLAWYQQKPGQAPRLLIYGAAIRATGIPARFSGSGSGTEFTLTISSLQSEDFALYYCQQYNNWWTFGQGTKVEIK

SEQ ID NO: 87 - protein, 127 aa, Artificial Sequence
  Synthetic
QVQLVESGGGVVQPGRSLRLSCAASGFTFSHYGMYWVRQAPGKGLEWVAVISYDGSNKYYADSVKGRFTISRDNSKNTLYVQMNSLRAEDTAVYYCAKNAGPYCSAHNCYSGPFDYWGQGTLVTVSS

SEQ ID NO: 88 - protein, 106 aa, Artificial Sequence
  Synthetic
DIQMTQSPSSLSASVGDRVTITCQASQDISNYLNWYQHKPGKAPKLLIYDASNLETGVPSRFSGSGSGTDFTFTITSLQPEDFATYYCQQYYNLPGFGPGTKVDIK

SEQ ID NO: 89 - protein, 126 aa, Artificial Sequence
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVGDSGGYYPAGLDYFDYWGQGTLVTVSS

SEQ ID NO: 90 - protein, 110 aa, Artificial Sequence
  Synthetic
EIVLTQSPGTLSLSPGERATLSCRASQSVSSDYLAWYQQKPGQAPRLLIYAASSRATGIPDRFSGSGSGTDFTLTISRLEPEDFAVYYCQQYGSSPPFVAFGQGTKVEIK

SEQ ID NO: 91 - protein, 121 aa, Artificial Sequence
  Synthetic
QVQLVQSGAEVKKPGSSVKVSCKASGGTFSSNAINWVRQAPGQGLEWMGGIIPIFGTVNYAQNFQGRVTITADESTSTAHMELSSLRSQDTAVYYCARDTVVSPLYGLDVWGQGTTVTVSS

SEQ ID NO: 92 - protein, 108 aa, Artificial Sequence
  Synthetic
DIQMTQSPSSLSASVGDRVTITCRASQSISSYLNWYQQKPGKAPKLLIYGATSLQSGVPSRFSGSGSGTDFTLTISSLQPEDFATYYCQQSYSTPRIIFGPGTKVDIK

SEQ ID NO: 93 - protein, 127 aa, Artificial Sequence
  Synthetic
QVQLVESGGGVVQPGRSLRLSCTVSGFTFSRYGMHWVRQAPGRGLEWVAVISYDGDNRYYADSVKGRFTISRDNSKNTLYLQMNSLRAEDTAVYYCAKKSGLYCGGSSCHSGTFDYWGQGTLVTVSS

SEQ ID NO: 94 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPLAFGQGTRLEIK

SEQ ID NO: 95 - protein, 123 aa, Artificial Sequence
  Synthetic
QVQLVESGGGVVQPGRSLRLSCAASGFTFSNYGMYWVRQAPGKGLEWVALISYDGSDKYYADSVKGRITISRDNSKNTLYLQMNSLRAEDTAVYNCAKCFYSYGYPCYYFDYWGQGTLVTVSS

SEQ ID NO: 96 - protein, 111 aa, Artificial Sequence
  Synthetic
NFMLTQPHSVSESPGKTVTISCTRSSGSIASNYVQWYQQRPGSAPTNVIYEDNQRPYGVPDRFSGSIDSSSNSASLTISGLKTEDEADYYCQSCDSNNLWVFGGGTKLTVL

SEQ ID NO: 97 - protein, 129 aa, Artificial Sequence
  Synthetic
QVQLVESGGGVVQPGRSLRLSCAASGFTFSNFAIHWVRQAPGKGLEWVAVLWYDGRNKDYADSVKGRFTISRDNSNNTLYLQMSSLRAEDTAVYYCARELYYYDRSGYYGPDDYAFDIWGQGTMVTVSS

SEQ ID NO: 98 - protein, 107 aa, Artificial Sequence
  Synthetic
DIQMTQSPSTLSASVGDRVTITCRASQSISSWLAWYQQKPGKAPKLLIYKASSLQSGVPSRFSGSGSGTEFSLTISSLQPDDFATYYCQHYNSYWRTFGQGTKVEIK

SEQ ID NO: 99 - protein, 121 aa, Artificial Sequence
  Synthetic
EVQLVESGGGLIQPGGSLRLSCAASGFTVSSNYMSWVRQAPGKGLEWVSLIYSGGSTYYADSVKGRFTISRDNSKNTVHLQMNSLRAEDTAVYYCARPRYGSRSYYAGDYWGQGTLVTVSS

SEQ ID NO: 100 - protein, 107 aa, Artificial Sequence
  Synthetic
DIQMTQSPSSLSAFVGDRVTITCQASQDINNYLNWYQQKPGKAPKLLIYDTSNLEIGVPSRFSGSGSGTYFTFTISSLQPEDIATYYCQQYDNLPITFGQGTRLEIK

SEQ ID NO: 101 - protein, 118 aa, Artificial Sequence
  Synthetic
EVQLVESGGGLIQPGGSLRLSCAASGIIVSRNYMTWVRQAPGKGLEWVSVIYSGGSTFYADSVKGRFTISRDNSKNTLYLKMNNLRAEDTAVYYCARDLGAAGALDFWGQGTLVTVSS

SEQ ID NO: 102 - protein, 108 aa, Artificial Sequence
  Synthetic
EIVLTQSPGTLSLSPGERATLSCRASQSVSSTFLAWYQQKPGQAPRLLIYGASSRATGIPDRFRGSGSGTDFTLTISRLEPEDFAVYYCQQYGSSPDTFGQGTKLEIK

SEQ ID NO: 103 - protein, 121 aa, Artificial Sequence
  Synthetic
EVQLVESGGGLVQPGGSLRLSCSASGFTFSSYAMHWVRQAPGKGLEYVSSITSDGVGTYYADSVKGRFTISRDNSKNTLYLQMRSLRAEDTAVYYCVSDSPTTMVTIFDYWGQGTLVTVSS

SEQ ID NO: 104 - protein, 107 aa, Artificial Sequence
  Synthetic
DIQMTQSPSSLSASVGDRVTITCRASQSISSYLNWYQQKPGKAPKLLIYVASSLQSGVPSRFSGSGSGTDFTLTISSLQPEDFATYYCQQSYSSLLTFGGGTKVEIK

SEQ ID NO: 105 - protein, 120 aa, Artificial Sequence
  Synthetic
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGRLGVVLGVDYWGQGTLVTVSS

SEQ ID NO: 106 - protein, 110 aa, Artificial Sequence
  Synthetic
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVL

SEQ ID NO: 107 - protein, 119 aa, Artificial Sequence
  Synthetic
EVQLVQSGAEVKKPGESLKISCKGSGYSFTSYWIGWVRQMPGKGLEWMGIIYPGDSDTRYSPSFQGQVTISADKSISTAYLQWRSLKASDTAMYYCARHDSSYVPPGLWGQGTLVTVSS

SEQ ID NO: 108 - protein, 110 aa, Artificial Sequence
  Synthetic
QSVLTQPPSASGTPGQRVTISCSGSSSNIGSNSVNWYHQLPGTAPKVLICYNNQRPSGVPDRFSGSKSGTSASLAISGLQSEDEADYYCAAWDDSLNGYVFGTGTKVTVL

SEQ ID NO: 109 - protein, 120 aa, Artificial Sequence
  Synthetic
EVQLVQSGAEVKKPGESLKISCKGSGYSFISHWIGWVRQMPGKGLEWMGIIYPGDSDTKYSPSFQGQVTISADKSISTAYLQWSSLKASDTAMYYCARIYSSSDNGMDVWGQGTTVTVSS

SEQ ID NO: 110 - protein, 110 aa, Artificial Sequence
  Synthetic
QSVLTQPPSASGTPGQRVTISCSGSSSNIGSNPVNWYQQLPGTAPKLLIYSNNQRPSGVPDRFSGSKSGTSASLAISGLQSEDEADYYCAAWDDSLNGWVFGGGTKLTVL

SEQ ID NO: 111 - protein, 117 aa, Artificial Sequence
  Synthetic
EVQLVESGGGLIQPGGSLRLSCAVSGFTVSRNYLNWVRQAPGKGLEGVSIIYPGGSTFYADSLKGRFTISRDNSKNTLYLQMNSLRAEDSAVYYCARSYGDYYLDFWGQGTLVTVSS

SEQ ID NO: 112 - protein, 107 aa, Artificial Sequence
  Synthetic
EIVLTQSPGTLSLTPGERATLSCRASQSVSSSYLSWYQQKPGQAPRLLFYGASGRATGIPDRFSGSGSGTDFTLTINRLEPEDFAVYYCQHYGRTWTFGQGTKVEIK

SEQ ID NO: 113 - protein, 117 aa, Artificial Sequence
  Synthetic
EVQLVESGGGLIQPGGSLRLSCAASDFIVSSNYMSWVRQAPGKGLEWVSVIYSGGSTYYADSVKGRFTISRDNSKNTLYLQMNSLRVEDTAVYYCARDWGDNYFDYWGQGTLVTVSS

SEQ ID NO: 114 - protein, 108 aa, Artificial Sequence
  Synthetic
EIVLTQSPGTLSLSPGERATLSCRASQSLSSRFLAWYQQKPGQAPRLLIYDASSRATGIPDRFRGSGSETDFTLTISRLEPEDFAVYYCQQYGSSPRTFGQGTKVEIK

SEQ ID NO: 115 - protein, 120 aa, Artificial Sequence
  Synthetic
EVQLVQSGAGVKRPGESLKISCKTSGYSFTNYWISWVRQMPGKGLEWMGAIDPRDSETRYSPSFQGQVTISADKSISTAYLQWSSLKTSDTATYYCAKGPPPSWGGFDQWGQGVLVTVSS

SEQ ID NO: 116 - protein, 112 aa, Artificial Sequence
  Synthetic
DVVMTQSPLSLAVTLGQPASISCTSSQSLVYSDGSTYLNWFHQRPGQSPRRLIYKVSNRDSGVPDRFSGSGSVTDFTLKISRVEAEDVGIYYCMQGTHWPPTFGQGTKLEIK

SEQ ID NO: 117 - protein, 127 aa, Artificial Sequence
  Synthetic
QVQLVESGGGVVQPGRSLRLSCAASGFTFSSYGMHWVRQAPGKGLEWVAVISYDGSDKYYADSVKGRFTISRDNSKNTLFLQMNSLRAEDTAVYYCAKQISRYCGGGSCYSLTIDYWGQGTLVTVSS

SEQ ID NO: 118 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 119 - protein, 115 aa, Artificial Sequence
  Synthetic
EVQLVESGGGLIQPGGSLRLSCAASGLIVSSNYMSWVRQAPGKGLEWVSVIYSGGSTYYADSVKGRFTISRDNSKNTLYLQMNSVRAEDTAVYYCAREVYGMDVWGQGTTVTVSS

SEQ ID NO: 120 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNIYPPPFGPGTKVDIK

SEQ ID NO: 121 - protein, 117 aa, Artificial Sequence
  Synthetic
EVQLVESGGGLIQPGGSLRLSCAASGVTVSSNYMTWVRQAPGKGLEWVSVIYSGGSTYYADSVKGRFTISRDNSKNTLYLQMNSLRAEDTAVYYCARSLEAYGMDVWGQGTTVTVSS

SEQ ID NO: 122 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYGYTFGQGTKLEIK

SEQ ID NO: 123 - protein, 124 aa, Artificial Sequence
  Synthetic
QVQLVQSGPEVKKPGASVKVSCKASGYTFTSYGISWVRQAPGQGLEWMGWISTYNGNTNYAQKLQGRVTMTTDSSTSTAYMELRSLRSDDTAVFYCARVGTYYSDSSAYYFDYWGQGTLVTVSS

SEQ ID NO: 124 - protein, 109 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYDNWPPIFTFGPGTKVDIK

SEQ ID NO: 125 - protein, 124 aa, Artificial Sequence
  Synthetic
EVQLVESGGGLIQPGGSLRLSCAASGFTVRSGYMSWVRQAPGKGLEWVSAIYSGSSTYYADSVKGRFTISRDNSKNTLYLQMNSLRAEDTAMYYCARFIPPDSRGYSSGAFDIWGQGTMVTVSS

SEQ ID NO: 126 - protein, 110 aa, Artificial Sequence
  Synthetic
QSALTQPASVSGSPGQSITISCTGTSSDVGTYDLVSWYQQHPGKAPKLMIYEGSKRPSGVSNRFSGSKSGNTASLTISGLQAEDEADYYCCSYAGSSTWVFGGGTKLTVL

SEQ ID NO: 127 - protein, 128 aa, Artificial Sequence
  Synthetic
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARTLSYYDSSGTLLYEDYFDYWGQGTLVTVSS

SEQ ID NO: 128 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL

SEQ ID NO: 129 - protein, 123 aa, Artificial Sequence
  Synthetic
QVQLVQSGAEVKKPGASVKVSCKASGYTFTNYYMHWVRQAPGQGLEWMGIINPSGGATTYAQKFQGRVTMTGDTSTRTVYMELSSLRSEDTAVYYCARGGSPIPAPGSDFDYWGQGTLVTVSS

SEQ ID NO: 130 - protein, 111 aa, Artificial Sequence
  Synthetic
QSALTQPASVSGSPGQSITISCTGTSSDVGSYNLVSWYQQHPGKAPKLMIYEVSKRPSGVSNRFSGSKSGNTASLTISGLQAEDEADYYCCSYAGRSTFVVFGGGTKLTVL

SEQ ID NO: 131 - protein, 130 aa, Artificial Sequence
  Synthetic
QVQLVQSGAEVKKPGSSVKVSCKASGGTFSSYAISWVRQAPGQGLEWMGGIIPIFDTTNYAQKFQGRVSITADESTSTSYMQLSSLRSEDTAVYYCARVRGTAAAGPNEHIAAAGTFDYWGQGTLVTVSS

SEQ ID NO: 132 - protein, 113 aa, Artificial Sequence
  Synthetic
DIVMTQSPDSLAVSLGERATINCKSSQSVLYSSNNKNYLAWYQQKPGQPPKLLIYWASTRESGVPDRVSGSGSGTDFTLTISSLQAEDVAVYYCQQYYSTQITFGQGTRLEIK

SEQ ID NO: 133 - protein, 121 aa, Artificial Sequence
  Synthetic
QVQLVQSGAEVKKPGSSVKVSCKASGGTFSSYAISWVRQAPGQGLEWMGGVIPLFGTANYAQKFQGRVTITADKSTNTAYMELSSLRSEDTAVYYCARGGGSSGYNWFDPWGQGTLVTVSS

SEQ ID NO: 134 - protein, 107 aa, Artificial Sequence
  Synthetic
DIQMTQSPSSLSASVGDRVTITCRASQSINNFLNWYQQKPGKAPKLLIYAASTLQSGVPSRFSGSGSGTDFTLTISSLQPEDFASYYCQQSSSILYTFGQGTKLEIK

SEQ ID NO: 135 - protein, 127 aa, Artificial Sequence
  Synthetic
QVQLVQSGAEVKKPGASVKVSCKASGYTFTSYDINWVRQATGQGLEWMGWMNPISGNTGYAQKFQGRVTMTRNTSISTAYMELSSLRSEDTAVYYCARGGRYCSGDSCYSNIWFDPWGQGTLVTVSS

SEQ ID NO: 136 - protein, 108 aa, Artificial Sequence
  Synthetic
DIQLTQSPSFLSASVGDRVTITCRASQGISNYLAWYQQKPGKAPKVLIYAASTLQSGVPSRFSGSGSGTEFTLTISSLQPEDFATYYCQQLNSYPGITFGQGTRLEIK

SEQ ID NO: 137 - protein, 126 aa, Artificial Sequence
  Synthetic
EVQLVESGGGLVQPGGSLRLSCAASGFTFSRYDMHWVRQPTGKGLEWVSTLDTAGDPYYAGSVKGRFTISRENAKNTLYLQMNSLRAGDTAVYYCARERRYYDSSGYHRRDGMDVWGQGTTVTVSS

SEQ ID NO: 138 - protein, 107 aa, Artificial Sequence
  Synthetic
DIQMTQSPSSLSASVGDRVTITCQASQDITNFLNWYQQKPGKAPRLLIYDASNLEPGVPSRFSGSGSGTDFTFTISSLQPEDIATYYCQQYDNLPPLTFGGGTKVEI

SEQ ID NO: 139 - protein, 127 aa, Artificial Sequence
  Synthetic
QVQLVESGGGVVQPGRSLRLSCAASGFTFSNYGMHWVRQAPGKGLEWVAVISFDGSHKYYVDSVKGRFTISRDNSKKRLYLQMNSLRAEDTAVYYCAKQAELYCSAGSCYEGYIDYWGQGTLVTVSS

SEQ ID NO: 140 - protein, 108 aa, Artificial Sequence
  Synthetic
EIVLTQSPGTLSLSPGERATLSCRASQSVSNSYLAWYQQKPGQAPRLLISGASSRATGIPDRFSGSGSGTDFTLTISRLEPEDFAIYYCQQYGSSPGTFGQGTKVEIK

SEQ ID NO: 141 - protein, 120 aa, Artificial Sequence
  Synthetic
QVQLVESGGGVVQPGRSLRLSCAASGFTFSSYGMHWVRQAPGKGLEWVAVIWYDGSNKHYADSVKGRFTISRDNSKNTLYLQMNSLRAEDTAVYYCARDYGDYVTYPDYWGQGTLVTVSS

SEQ ID NO: 142 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 143 - protein, 117 aa, Artificial Sequence
  Synthetic
EVQLVESGGGLIQPGGSLRLSCAASGFTVSSNYMYWVRQAPGKGLEWVSVIFSGGSTFYADSVKGRFTISRDSSKNTLYLQMNSLRAEDTAVYYCARGPYPAADNYWGQGTLVTVSS

SEQ ID NO: 144 - protein, 107 aa, Artificial Sequence; identical to SEQ ID NO: 118
  Synthetic

SEQ ID NO: 145 - protein, 125 aa, Artificial Sequence
  Synthetic
QVQLQESGPGLVKPSQTLSLTCTVSGGSISSGDYYWSWIRQPPGKGLEWIGYIYYSGSTYYNPSLQSRVTISVDTSKNQFSLKLSSVTAADTAVYYCARDGCSGGSCYSYWFDPWGQGTLVTVSS

SEQ ID NO: 146 - protein, 106 aa, Artificial Sequence
  Synthetic
EIVLTQSPATLSLSPGERATLSCRASQSVSGYLAWYQQKPGQAPRLLIYDASNRATGIPARFSGSGSGTDFTLTISSLEPEDFAVYYCQQRSSWSTFGQGTRLEIK

SEQ ID NO: 147 - protein, 124 aa, Artificial Sequence
  Synthetic
QVQLVQSGAEVKKPGSSVKVSCKASGGTFSSFAISWVRQAPGQGLEWMGGIIPIFGTANYAQKFQGRVTITADESTSTAYMELSSLRSEDTAVYYCARFGDYHDNRGYSYSDYWGQGTLVTVSS

SEQ ID NO: 148 - protein, 107 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSRTFGQGTKVEIK

SEQ ID NO: 149 - protein, 121 aa, Artificial Sequence
  Synthetic
QVQLVQSGAEVKKPGSSVKVSCKASGGTLSSHAISWVRQAPGQGFEWMGGIIPIFGTANYAQKFQGRVTITADESTSTAYMELSSLRSEDTAVYYCARDHEMATIYGMDVWGQGTTVTVSS

SEQ ID NO: 150 - protein, 108 aa, Artificial Sequence
  Synthetic
DIQMTQSPSSLSASVGDRVTITCRASQSIGSYLNWYQQKPGKAPKLLIYAASSLQSGVPSRFSGSGSGTDFTLTISSLQPEDFATYYCQQSYSAPLLTFGLGTKVDIK

SEQ ID NO: 151 - protein, 126 aa, Artificial Sequence
  Synthetic
QVQLVESGGGVVQPGRSLRLSCAASGFTFSSYGMHWVRQAPGKGLEWVAGISYDGSNKYYADSVKGRFTISRDNSKNTLYLQMNSLRAEDTAVYYCAKGGYYYYGSGSYNYGFDYWGQGTLVTVSS

SEQ ID NO: 152 - protein, 107 aa, Artificial Sequence
  Synthetic
DIQMTQSPSSLSASVGDRVTITCQASQDISNYLSWYQQKPGKAPKLLIYDASYLETGVPSRFSGSGSGTDFTFTISSLQPEDIATYYCQQYDNLIFTFGPGTKVDIK

SEQ ID NO: 153 - protein, 123 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKERSWYYYDSSGSDYWGQGTLVTVSS

SEQ ID NO: 154 - protein, 112 aa, Artificial Sequence
  Synthetic
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSISSWVFGGGTKLTVL

SEQ ID NO: 155 - protein, 123 aa, Artificial Sequence
  Synthetic
EVQLVESGGGLVQPGGSLRLSCAASGFTFSSYNMNWVRQAPGKGLEWVSYIGSTSSTIYYADSVKGRFTISRDNAKNSLYLQMNSLRDEDTAVYYCARHQGSLSYYYHGMDVWGQGTTVTVSS

SEQ ID NO: 156 - protein, 107 aa, Artificial Sequence
  Synthetic
DIQMTQSPSSLSASVGDRVTITCRASQSISSYLNWYQQKPGKAPKLLIYTASSLQSGVPSRFSGSGSGTDFTLTISSLQPEDLATYYCQQSYSTPSTFGPGTKVDIK

SEQ ID NO: 157 - protein, 117 aa, Artificial Sequence
  Synthetic
EVQLVESGGGLIQPGGSLRLSCAASGFIVSSNYMSWVRQAPGKGLEWVSVVYSGGSTFYADSVKGRFTISRDNSKNTLYLQMNSLRAEDTAVYYCARDYGDYYFDYWGQGTLVTVSS

SEQ ID NO: 158 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKLEIK

SEQ ID NO: 159 - protein, 115 aa, Artificial Sequence
  Synthetic
EVQLVESGGGLIQPGGSLRLSCAASGFTVSSNYMSWVRQAPGKGLECVSVLYSGGSSFYADSVKGRFTISRDNSKNTLYLQMNSLSAEDTAMYYCARWARGFDPWGQGTLVTVSS

SEQ ID NO: 160 - protein, 109 aa, Artificial Sequence
  Synthetic
QSALTQPASVSGSPGQSITISCTGTSSDVGGYNYVSWYQHRPGKAPKLMIYDVGTRPSGISNRFSGSKSDNTASLTISGLQAEDEADYYCSSYTSSIPVFGGGTKLTVL

SEQ ID NO: 161 - protein, 121 aa, Artificial Sequence
  Synthetic
EVQLVESGGGLVQPGGSLRLSCSASGFTFSSYVMDWVRQAPGKGLEYVSGISTNGDITNYADSVKGRFTISRDNSKNTLYLQMSSLRAEDTAVYYCVKDLGLGTVDYFDYWGQGTLVTVSS

SEQ ID NO: 162 - protein, 106 aa, Artificial Sequence
  Synthetic
DIQMTQSPSSLSASVRDRVTITCRASQSISNYLSWFQQKPGKAPKLLIYAASTLQSGVPSRFSGSGSGTDFTLTISSLQPEDFATYYCQQSYTTVTFGGGTKVEIK

SEQ ID NO: 163 - protein, 120 aa, Artificial Sequence
  Synthetic
EVQLVESGGGLVQPGGSLRLSCAASGFTFSSYLMSWVRQAPGKGLEWVANIKQDGSEKYYVDSVKGRFTISRDNAKNSLYLQMNSLRAEDTAVYYCARARLGQLLGFDYWGQGTLVTVSS

SEQ ID NO: 164 - protein, 110 aa, Artificial Sequence
  Synthetic
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDTSNWVFGGGTKLTVL

SEQ ID NO: 165 - protein, 118 aa, Artificial Sequence
  Synthetic
EVQLVQSGAEVKKPGESLKISCKGSGYSFISHWIGWVRQMPGKGLEWMGIIYPGDSDTRYSPSFQGQVTISADKSISTAYLQWSSLKASDTAMYYCARRGSAWELDYWGQGTLVTVSS

SEQ ID NO: 166 - protein, 110 aa, Artificial Sequence
  Synthetic
QSVLTQPPSASGTPGQRVTISCSGSSSNIGSNPVNWYRQLPGTAPKLLIYSNNQRPSGVPDRFSGSKSGTSASLAISGLQSEDEADYYCAAWDDSLNGYVFGTGTKVTVL

SEQ ID NO: 167 - protein, 120 aa, Artificial Sequence
  Synthetic
EVQLVQSGAEVKKPGESLKISCKGSGYSFTSQWIGWVRQMPGKGLEWMGIIYPGDSDTRYSPSFQGQVTISADKSISTAYLQWSSLKASDTAMYYCGRQVADAASGMDVWGQGTTVTVSS

SEQ ID NO: 168 - protein, 110 aa, Artificial Sequence
  Synthetic
QSVLTQPPSASGTPGQRVTISCSGSSSNIGSNPVNWYQQLPGTAPKLLIYNNNQRPSGVPDRFSGSKSGTSASLAISGLQSEDEADYYCAAWDDSLNGQVFGGGTKLTVL

SEQ ID NO: 169 - DNA, 390 bp, Artificial Sequence
  Synthetic
caggtgcagctgcaggagtcgggcccaggactggtgaagccttcggagaccctgtccctcacctgcactgtctctggtggctccatcaatagttactactggaactggatccggcagcccccagggaggggactggagtggattgcgtatatattttacagtgggggcaccaactacaatccctccctcaagagtcgagtcaccatatcagtagacacgtccaagaaccaattctccctgaagctgagctctgtgaccgctgcggacacggccgtgtatttctgtgcgagagccgctggagttcgttcagtgctggcagctgcttctagctactactactactacggactggacgtctggggccaagggaccacggtcaccgtctcctca

SEQ ID NO: 170 - DNA, 327 bp, Artificial Sequence
  Synthetic
cagtctgccctgactcagcctgcctccgtgtctgggtctcctggacagtcgatcaccatctcctgcactggaacgagcagtgacgttggtggttataattatgtctcctggtaccaacaacacccaggcaaagcccccaaactcatgatttatgatgtcagtaatcggccctcaggggtttctaatcgcttctctggcgccaagtctggcaacacggcctccctgaccatctctgggctccaggctgaggacgaggctgattattactgcagctcatatacaagcagcggttgggtgttcggcggagggaccaagctgaccgtccta

SEQ ID NO: 171 - DNA, 364 bp, Artificial Sequence
  Synthetic
caggtgcagctggtggagtctgggggaggcttggtagagccagggcggtccctgagactctcctgtacaggttctggattcacctttggtgattatgttctgagctgggtgcgccaggctccagggaaggggctggagtgggtaggtttcattagaagcaaagcttatggagagacaacagaacacgccgcgtctgtgaaaggcagattcaccatctcaagagatgattccaaaagcatcgcctatctgcaaatgagtagcctgaaaaccgaggacacagccgtgtatttctgtgccagaggcctgaggcccacccgaaaagcagactactggggccagggaaccctggtcaccgtctcctcag

SEQ ID NO: 172 - DNA, 334 bp, Artificial Sequence
  Synthetic
cagtctgccctgactcagcctgcctccgtgtctgggtctcctggacagtcgatcaccatctcctgcactgggacccgcagtgacgttggtggttataactctgtctcctggtaccgacaacacccaaacaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcaccactctcgacgtcttcggaactgggaccaaggtcaccgtcctag

SEQ ID NO: 173 - DNA, 400 bp, Artificial Sequence
  Synthetic
caggtgcagctggtgcagtctggggctgaggtgaagaagcctgggtcctcggtgaaggtctcctgcaaggcttctggaggcaccttcagcagctatgctatcaactgggtgcgacaggcccctggacaagggcttgagtggatgggaggcatcatccctatctttcgcacagcaaactacgcacagaagttccagggcagagtcacgattaccgcggacgaatccacgaggacagtctacatggaactgagcagcctgagatctgaggacacggccatgtattactgtgcgagggggggggaagagggtatagcagtggctgctaagggctggactgaacagaattacgaaaactggttcgacccctggggccagggaaccctggtcaccgtctcctcag

SEQ ID NO: 174 - DNA, 340 bp, Artificial Sequence
  Synthetic
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatatcatagtactccgctcactttcggcggagggaccaaggtggaaatcaaac

SEQ ID NO: 175 - DNA, 376 bp, Artificial Sequence
  Synthetic
caggtgcagctggtgcagtctggggctgaggtgaagaggcctggggcctcagtgaaggtttcctgcaaggcatctggatacaccttcaccagctactatatgcactgggtgcgacaggcccctggacaagggcttgagtggatgggaataatcaaccctagtggtagtagcacaagttacgcacagaagttccagggcagagtcaccctgaccagggacacgtccacgagcacagtctacatggagctgagcagcctgagacctgaggacacggccgtgtattactgtgcgagcggatattgtagtagtggcagctgccatgcaggggatgcttttgatatctggggccaagggacaatggtcaccgtctcttcag

SEQ ID NO: 176 - DNA, 322 bp, Artificial Sequence
  Synthetic
gacatccagatgacccagtctccatcctccctgtctgcatctgtaggagacagagtcaccatcacttgccgggcaagtcagagcatgagcaactatttaaattggtatcagcagaaaccagggaaagcccctaagctcctgatctatgctgcatccagtttgcaaagtggggtcccagcaaggttcagtggcagtggatctgggacagatttcactctcaccatcagcagtctgcaacctgaagattttgcaacttactactgtcaacagagttacagtacccctcccactttcggcggagggaccaaggtggaaatcaaac

SEQ ID NO: 177 - DNA, 361 bp, Artificial Sequence
  Synthetic
cagctgcagctgcaggagtcgggcccaggactggtgaagccttcggagaccctgtccctcacctgcactgtctctggtgcctccgtcagcagtagtacttactactgggtctggatccgccggccccccgggaaggggctggagtggattgggactatctattatagtgggagcacctactacagcccgtccctcaagagtcgactcaccatatcagttgacacgtccaagaaccagttctccctgaggctgagttctgtgaccgccgcggacacggccatttattactgtgcgcagtcaacgtggctaaggggatcctttgactactggggccagggaaccctggtcaccgtctcctcag

SEQ ID NO: 178 - DNA, 334 bp, Artificial Sequence
  Synthetic
aattttatgctgactcagccccactctgtgtcggagtctccgggtaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaattctgcctccctcaccatctctggactgaagactgaggacgaggctgactactactgtcagtcttatgatagcaccaatcattgggtgttcggcggagggaccaagctgaccgtcctag

SEQ ID NO: 179 - DNA, 352 bp, Artificial Sequence
  Synthetic
caggtgcagctgcaggagtcgggcccaggactggtgaagccttcggggaccctgtccctcacctgcgctgtctctggtggctccatcagcagtaatgactggtggaattgggtccgccaacccccagggaaggggctggagtggattggggaaatctatcatagtgggagcaccaactacaacccgtccctcaagagtcgagtcatcatatcagtagacaagtctaagaaccagtttgccctgaacctgagctctgtgaccgccgcggacacggccatatattactgtgcgcgcaactgcgcctggggatcctgcgactggggccagggaaccctggtcaccgtctcctcag

SEQ ID NO: 180 - DNA, 331 bp, Artificial Sequence
  Synthetic
caggctgtggtgacccaggagccagcgttctcagtgtcccctggcgggacagtcacactcacttgtggcttgagctctggctcagtctctacaagtcatcacccctgctggtaccaacaaaccccaggccaggctccacgcacgctcatctacgatacagacgctcgctcttctggggtccctgatcgcttctctggctccatccttggggacaaagctgccctcaccatcacgggggcccaggcagatgatgaatctgattattactgtgctctctatatgggtagtggctcctgggtgttcggcggagggaccaagttgaccgtcctag

SEQ ID NO: 181 - DNA, 358 bp, Artificial Sequence
  Synthetic
caggttcagctggtgcagtctggagctgaggtgaagaagcctggggcctcagtgaaggtctcctgcaaggcttctggttacacctttaccacctatggtatcagctgggtgcgacaggcccctggacaagggcttgagtggatgggatggatcagcgcttacaatggtaacacaaagtatgcacagaagctccagggcagagtcaccatgaccacagacacatccacgagcactgcctacatggagctgaggagcctgagatctgacgacacggccgtgtattactgtgcgagaggtatagcggccctatttggctttgactactggggccagggaaccctggtcaccgtctcctcag

SEQ ID NO: 182 - DNA, 337 bp, Artificial Sequence
  Synthetic
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgaaggagtggtattcggcggagggaccaagctgaccgtcctag

SEQ ID NO: 183 - DNA, 361 bp, Artificial Sequence
  Synthetic
caggtgcagctggtgcagtctggggctgaggtgaagaagcctggggcctcagtgaaggtttcctgcaaggcatctggatacaccttcaccatgtaccatatgcactgggtgcgacaggcccctggacaagggcttgagtggatgggaataatcaaccctagtggtggaagtacaaggtacgcacagcagttacagggtagagtcagcatgaccagggacacgtccacgagcacagtctacatggagctgagcagcctgagatctgaggacacggccttttattactgtgcgagagaagacgtgggaggtacggggtattttgactactggggccagggaaccctggtcaccgtctcctcag

SEQ ID NO: 184 - DNA, 328 bp, Artificial Sequence
  Synthetic
tcctatgagctgactcagccaccctcggtgtcagtggccccaggacagacggccaggattacctgtggggcaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatggtagtagtgatcatttttatgtcttcggaactgggaccacggtcaccgtcctag

SEQ ID NO: 185 - DNA, 382 bp, Artificial Sequence
  Synthetic
gaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagactacatggagctgagcagcctgagatctgaggacacggccgtgtattactgtgcgagagagggttctgctcattatgatagtagtggcttaaacgctgaatacttccagcactggggccagggcaccacggtcaccgtctcctcag

SEQ ID NO: 186 - DNA, 334 bp, Artificial Sequence
  Synthetic
cagtctgtgctgactcagccgccctcagtgtctggggccccagggcagagggtcaccatctcctgcactgggagcagctccaacatcggggcaggttatgatgtacactggtaccagcagcttccaggaacagcccccaaactcctcatctatggtaacaccaatcggccctcaggggtccctgaccgaatctctggctccaagtctggcacctcagcctccctggccatctctgggctccaggctgaggatgaggctgattattactgccagtcctatgacagcagcctgattgcctccttgttcggcggagggaccaagctgaccgtcctag

SEQ ID NO: 187 - DNA, 358 bp, Artificial Sequence
  Synthetic
gaggtgcagctggtggagtctggggctgaggtgaagaagcctggggcctcagtgaaggtctcctgcaaggcttctggatacagcttcaccagttatgatatcaactgggtgcgacaggccactggacaagggcttgagtggatgggatggatgaaccctaacagtggtaacagaggctatgcacagaagttccagggcagagtgaccatgaccaggaacacctccataagcacagcctacatggagctgagcggcctgacatctgaggacacggccgtgtatttctgtgcgagaggtgtgggccttacgtactactttgactactggggccagggaaccacggtcaccgtctcctcag

SEQ ID NO: 188 - DNA, 325 bp, Artificial Sequence
  Synthetic
tcctatgagctgactcagccaccctcggtgtcagtggccccaggacagacggccaggattacctgtgggggaaacagcattggaagtaaaagtgtgcactggtaccaccagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtactgatcccgtggtattcggcggagggaccaagctgaccgtcctag

SEQ ID NO: 189 - DNA, 354 bp, Artificial Sequence
  Synthetic
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaacatctccagagacaattccaagaacacgctgtatcttcaaatgaacagcctgagagccgaggacacggccgtgtattactgtgcgagagatttagaagcagctgggggtatggacgtctggggccaagggaccacggtcaccgtctcctca

SEQ ID NO: 190 - DNA, 322 bp, Artificial Sequence
  Synthetic
cacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatggttacccgctcactttcggcggagggaccaaggtggaaatcaaac

SEQ ID NO: 191 - DNA, 351 bp, Artificial Sequence
  Synthetic
gaggtgcagctggtggagtctggaggaggcttgatccagcctggggggtccctgagactctcctgtgcagcctctggactcaccgtcagtagcaactacatgagctgggtccgccaggctccagggaaggggctggagtgggtctcagttatttatagcggtggcagcacatactacgcagactccgtgaagggccgattcaccatctccagagacaattccaagaacacgctgtttcttgaaatgaacagcctgagagccgaggacacggccgtgtattactgtgcgagagatcttgactactacggtatggacgtctggggccaagggaccacggtcaccgtctcctca

SEQ ID NO: 192 - DNA, 325 bp, Artificial Sequence
  Synthetic
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccgtcaaggttcagcggcagtggatctgggacagaattcactctcacaatcagcagcctgcagcctgaagattttgcaacttattactgtcaacttcttaatagttaccctcggctcactttcggcggagggaccaaggtggagatcaaac

SEQ ID NO: 193 - DNA, 352 bp, Artificial Sequence
  Synthetic
gaggtgcagctggtggagtctggaggaggcttgatccagcctggggggtccctgagactctcctgtgcagccactgggttcatcgtcagtagcaactacatgagctgggtccgccaggctccagggaaggggctggagtgggtctcagttatttatagcggtggtagcacattctacgcagagtccgtgaagggccgattcaccatctccagagacaattccaagaacacgctgtatcttcaaatgaacagcctgagagccgaggacacggccgtgtattactgtgcgagagattggggagaatactactttgactactggggccagggaaccctggtcaccgtctcctcag

SEQ ID NO: 194 - DNA, 325 bp, Artificial Sequence
  Synthetic
gaaattgtgttgacgcagtctccaggcaccctgtctttgtctccaggggaaagagccaccctctcctgcagggccagtcagattgttagcagcagttacttagcctggtaccagcagaaacctggccaggctcccaggctcctcatctatggtgcatccagcagggccactggcatcccagacaggttcagtggcagtgggtctgggacagacttcactctcaccatcagcggactggagcctgaagattttgcagtgtattactgtcagcagtatgatagctcacctcgaacgttcggccaagggaccaaggtggaaatcaaac

SEQ ID NO: 195 - DNA, 360 bp, Artificial Sequence
  Synthetic
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcaactatttatagcggtggtagtacatattacgcagactccgtgaagggccgattcaccatctccagagacaattccaagaacacgctgtatcttcaaatgaacagcctgagagccgaggacacggccgtgtattactgtgcgagagatcacgtggccgctatggttcagggacagggcgtctggggccaagggaccacggtcaccgtctcctca

SEQ ID NO: 196 - DNA, 322 bp, Artificial Sequence
  Synthetic
gacatccagatgacccagtctccatcctccctgtctgcatctgtaggagacagagtcaccatcacttgccaggcgagtcaggacattaccaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacaatatgataatctcccactcactttcggcggagggaccaaggtggagatcaaac

SEQ ID NO: 197 - DNA, 351 bp, Artificial Sequence
  Synthetic
gaggtgcagctggtggagtctggaggaggcttgatccagccgggggggtccctgagactctcctgtgcggcctctgggatcctcgtcagtagcaactacatgaactgggtccgccaggctccagggatggggctggagtgggtctcagttatttatagcggtggtagcacattctacgcagactccgtgaagggccgattcaccatctccagagacaattccaagaacacgctgtatcttcaaatgaacagcctgagagccgaggacacggccatgtattactgtgcgagagatctgggggtatccggtatggacgtctggggccaagggaccacggtcaccgtctcctca

SEQ ID NO: 198 - DNA, 319 bp, Artificial Sequence
  Synthetic
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaaatggggtcccatcaaggttcagcggcagtggatctgggacagaattcactctcacaatcagcagcctgcagcctgaagattttgcaacttattactgtcaacaccttaatagttactcccttttcggccctgggaccaaagtggatatcaaac

SEQ ID NO: 199 - DNA, 352 bp, Artificial Sequence
  Synthetic
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagagatcgtgggggagccctccatgactactggggccagggaaccctggtcaccgtctcctcag

SEQ ID NO: 200 - DNA, 331 bp, Artificial Sequence
  Synthetic
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctgagggtatattcactttcggccctgggaccaaagtggatatcaaac

SEQ ID NO: 201 - DNA, 367 bp, Artificial Sequence
  Synthetic
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgacgacacggccgtatattactgtgcgaaagatcttaacgcgttgcaacacgtcgagacattcgacccctggggccagggaaccctggtcaccgtctcctcag

SEQ ID NO: 202 - DNA, 325 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccccaagctcctgatctatgctgcatccagtttgcaaagtggagtcccatcaaggttcagtggcagtggatctgggacagatttcactctcaccatcagcagtctgcaacctgaagattttgcaacttactactgtcaacagagttacagtaccctcccgtacacttttggccaggggaccaagctggagatcaaac

SEQ ID NO: 203 - DNA, 373 bp, Artificial Sequence
  Synthetic
caggtgcagctggtggagtctgggggaggcgtggtccagcctgggaggtccctgagactctcctgtgcagtctctggattcaccttcagtatctatggcatgcactgggtccgccaggctccaggcaaggggctggagtgggtggcagttatatcatatgatggagataataaatactctgcagactccgtgaagggccgattcaccatctccagagacaattccaagaacacgctgtatctgcaaatgaacagcctgagagctgaggacacggctgtgtattactgtgcgaaggggtcgtattacgatattttgactggttattatggactggactactggggccagggaaccctggtcaccgtctcctcag

SEQ ID NO: 204 - DNA, 337 bp, Artificial Sequence
  Synthetic
gatattgtgatgactcagtctccactctccctgcccgtcacccctggagagccggcctccatctcctgcacgtctagtcagagcctcctgtatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaccccgtacacttttggccaggggaccaagctggagatcaaac

SEQ ID NO: 205 - DNA, 385 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagattctcactactattactatgatagtagtggttattacggtagtattcctgactactggggccagggaaccctggtcaccgtctcctcag

SEQ ID NO: 206 - DNA, 340 bp, Artificial Sequence
  Synthetic
gatattgtgatgactcagtctccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccccattcggctttcggccctgggaccaaagtggatatcaaac

SEQ ID NO: 207 - DNA, 373 bp, Artificial Sequence
  Synthetic
gaggtgcagctggtggagtctgggggaggcttggtacagcctggggggtccctgagactctcctgtgcagcctctggattaaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagtgggggcgaggataactggaacttcgacctactactttgactactggggccagggaaccctggtcaccgtctcctcag

SEQ ID NO: 208 - DNA, 328 bp, Artificial Sequence
  Synthetic
gaaattgtgttgacacagtctccagccaccctgtctttgtctccaggggaaagagccaccctctcctgcagggccagtcagagtgttagcagctacttagcctggttccaacacaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcacctggcctcgcggattcactttcggccctgggaccaaagtggatatcaaac

SEQ ID NO: 209 - DNA, 367 bp, Artificial Sequence
  Synthetic
gaggtgcagctggtggagtctgggggaggcttggtacagcctggggggtccctgagactctcctgtgcagcctctggattcaccttcagtacctacgacatgcactgggtccgccaagctacaggaaaaggtctggagtgggtctcaactattggtactgctggtgacacatactatctaggctccgtgaagggccgattcaccatctccagagaaaatgccaagaactccttgtatcttcaaatgaacagcctgagagccggggacacggctgtgtattactgtgcaagagcccgtgggggtacagctatggcaccctactactttgactactggggccagggaaccctggtcaccgtctcctcag

SEQ ID NO: 210 - DNA, 325 bp, Artificial Sequence
  Synthetic
gacatccagatgacccagtctccatcctccctgtctgcatctgtaggagacagagtcaccatcagttgccgggcaagtcagagcattagcaactttttaaattggtatcagcagaaaccaggtaaagcccctaagctcctgatatatgctgcatccagtttgcaaagtggggtcccatcaaggttcagtggcagtggatctgggacagatttcactctcaccatcagcagtctgcaacctgaagattttgcaacttactactgtcaacagagttacattacccctcatctcactttcggcggagggaccaaggtggaaatcaaac

SEQ ID NO: 211 - DNA, 396 bp, Artificial Sequence
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcaccattaccgcggacgaatccacgagcacagcctacatggagctgagcagcctgagatctgaggacacggccgtgttttactgtgcgatagaacgatattgtactaatggtgtatgctccgcacccgggccttcctactactactacgctatggacgtgtggggccaagggaccacggtcaccgtctcctca

SEQ ID NO: 212 - DNA, 319 bp, Artificial Sequence
  Synthetic
gacatccagatgacccagtctccatcctccctgtctgcatctgtaggagacagagtcaccattacttgccaggcgagtcaggacattagcaactatttaaattggtatcagcataaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcttttcggccctgggaccaaagtggatatcaaac

SEQ ID NO: 213 - DNA, 373 bp, Artificial Sequence
  Synthetic
caggtgcagctggtgcagtctggggctgaggtgaagaagcctgggtcctcggtgaaggtctcctgcaaggcttctggaggcaccttcagcagctatgctatcacctgggtgcgacaggcccctggacaagggcttgagtgcatgggaaggatcatccctatccttggtatagcatactacgcacagaagttccagggcagagtcacgattaccgcggaccaatccacgagcacagcctacatggagctgagcagcctgagatctgaggacacggccgtgtattactgtgcgagagagtttgcagtagtaccagttgcctccacgtggtggttcgacccctggggccagggaaccctggtcaccgtctcctcag

SEQ ID NO: 214 - DNA, 334 bp, Artificial Sequence
  Synthetic
cagtctgtgctgactcagccgccctcagtgtctggggccccagggcagagggtcaccatctcctgcactgggaccagctccaacatcggggcaggttatgatgtacactggtaccagcaacttccaggaacagcccccaaactcctcatctatggtaacagcaatcggccctcaggggtccctgaccgattctctggctccaagtctggcacctcagcctccctggccatcactgggctccaggctgacgatgaggctgattattactgccagtcctatgacagcagcctgagtggttcggtattcggcgtagggaccaagctgaccgtcctag

SEQ ID NO: 215 - DNA, 366 bp, Artificial Sequence
  Synthetic
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacagcctatgcacagaagttccagggcagagtcaccatgaccaggaacacctccgtaagcacagcctacatggagctgagcagcctgagatctgaggacacggccgtgtattactgtgcgagagcaacccggagtgggagctacagttttgtcatggacgtctggggccaagggaccacggtcaccgtctcctca

SEQ ID NO: 216 - DNA, 331 bp, Artificial Sequence
  Synthetic
tcctatgagctgactcagccaccctcggtgtcagtggccccaggacagacggccaggattacctgtgggggaaacaacattggaagtaaaaatgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatccccttgtggtattcggcggagggaccaagctgaccgtcctag

SEQ ID NO: 217 - DNA, 382 bp, Artificial Sequence
  Synthetic
caggtgcagctggtggagtctgggggaggcttggtcaagcctggagggtccctgagactctcctgtgcagcctctggattcaccttcagtgactactacatgacctggatccgccaggctccagggaaggggctggagtgggtttcatacattactagtactagtagtttcacaaactacgcagactctgtcaggggccgattcaccatctccagagactacgccaagaactcactgtatctgcaaatgaccagcctgagagccgaggacacggctgtctattattgtgcgagagtgttcttaaggagtgcttacccatcatcgcgggtggtgtgggcctttgatatctggggccaagggacaatggtcaccgtctcttcag

SEQ ID NO: 218 - DNA, 319 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcatcatcagcagcctgcagcctgaagatattgcaacatattactgtcaacagtatgatttgggggtcactttcggccctgggaccaaagtggatatcaaac

SEQ ID NO: 219 - DNA, 385 bp, Artificial Sequence
  Synthetic
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtgttagtagtagttacacaaactacgcagactctgtgaagggccgattcaccatctccagagacaacgccaagaactcactgtatctgcaaatgaacagcctgagagccgaggacacggctgtgtattactgtgcgagagggggatattgtactagtaccagctgctataaggggttccccaactggttcgacccctggggccagggaaccctggtcaccgtctcctcag

SEQ ID NO: 220 - DNA, 322 bp, Artificial Sequence
  Synthetic
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctatcaccttcggccaagggacacgactggagattaaac

SEQ ID NO: 221 - DNA, 358 bp, Artificial Sequence
  Synthetic
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcatcatctccagagaaaatgccaagaactccttgtatcttcaaatgaacagcctgagagccggggacacggctgtgtattactgtgcaagaggggggagatggctacaaactgtcttcgatctctggggccgtggcaccctggtcaccgtctcctcag

SEQ ID NO: 222 - DNA, 325 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaacctcctgatctttgctgcatccagtttgcaaagtggggtcccatcaaggttcagtggcagtggatctgggacagatttcactctcaccatcagccgtctgcaacctgaagactttgcaacttactactgtcaacagagttacagtatgcctccggtcactttcggccctgggaccaaagtggatatcaaac

SEQ ID NO: 223 - DNA, 376 bp, Artificial Sequence
  Synthetic
gaggtgcagctgttggagtctgggggaggcttggtacagcctggggggtccctgagactctcctgtgcagcctctggattcacctttagcagctatgccatgagctgggtccgccaggctccaggtaaggggctggagtgggtctcagctattgttggaagtggtggtagcacatactacgcagactccgtgaagggccggttcaccatctccagagacaattccaagaacacggcgtatctgcaaatgaacagcctgagagccgaggacacggccgtatattactgtgcgaaagatgtgatggtgtggagtgggagctacttacctgaatacttccagcactggggccagggcaccctggtcaccgtctcctcag

SEQ ID NO: 224 - DNA, 316 bp, Artificial Sequence
  Synthetic
tcctatgagctgactcagccaccctcagtgtccgtgtccccaggacagacagccagcatcacctgctctggacataaattgggggataaatatgcttgctggtatcagcagaagccaggccagtcccctgtgctggtcatctatcaagataacaagcggccctcagggatccctgagcgattctctggctccaactctgggaacacagccactctgaccatcagcgggacccaggctatggatgaggctgactattactgtcagtcgtgggacagcagcgtggtattcggcggagggaccaagctgaccgtcctag

SEQ ID NO: 225 - DNA, 367 bp, Artificial Sequence
  Synthetic
gaggtgcagctgttggagtctgggggaggcttggtacagcctggggggtccctgagactctcctgtgcagcctctggaatcacctttagcaggcatgccatgagctgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcgatatgcggggccgtatagcagcagctctgactactggggccagggaaccctggtcaccgtctcctcag

SEQ ID NO: 226 - DNA, 322 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccagtcactttcggcggagggaccaaggtggaaatcaaac

SEQ ID NO: 227 - DNA, 376 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaatgaatactatgcagactccgtgaagggccgattcaccatctccagagacaattccaagaacacgctgtatctgcaaatgaacagcctgagagctgaggacacggctgtgtattactgtgcgaaggtgaactctcagtatagcagtgactggtacgaccgggcttttgactactggggccagggaaccctggtcaccgtctcctcag

SEQ ID NO: 228 - DNA, 319 bp, Artificial Sequence
  Synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaac

SEQ ID NO: 229 - DNA, 382 bp, Artificial Sequence
  Synthetic
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatttggaatgatggaagtaataaatactatgcagactccgtgaagggccgattcaccatctccagagacatttccaggaacacgctgtatctgcaaatgaacagcctgagagccgaggacacggctgtgtattactgtgcgagatctcagtattactatgataggagtggttatgcgaatcatgatgcttttgatatctggggccaagggacaatggtcaccgtctcttcag

SEQ ID NO: 230 - DNA, 325 bp, Artificial Sequence
  Synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctatgaggcgtctagtttagaaagtggggtcccatcaaggttcagcggcagtggatctgggacagaattcactctcaccatcagcagcctgcagcctgatgattttgcaacttattactgccaacagtataatagttaccttacgtggacgttcggccaagggaccaaggtggaaatcaaac

SEQ ID NO: 231 - DNA, 369 bp, Artificial Sequence
  Synthetic
gaggtgcagctggtggagtctgggggaggcttggtacagcctggggggtccctgagactctcctgtgcagcctctggattcaccttcactacctataatatgaactgggtccgccaggctccagggaaggggctggagtgggtttcatacattagtgatagtggtggcaccatatactacgcagactctgtgaagggccgattcaccatctccagagacaatgccaagaactcactgtatctgcaaatgaacagcctcagagacgaggacacggctgtgtattactgtgcgagagttaaggggaggagtagctactactactacggtatggacgtctggggccaagggaccacggtcaccgtctcctca

SEQ ID NO: 232 - DNA, 322 bp, Artificial Sequence
  Synthetic
gacatccagatgacccagtctccatcctccctgtctgcatctgtaggagacagagtcaccatcacttgccgggcaagtcagaacatttacatctatttaaattggtatcagcagaaaccagggaaagcccctaaggtcctgatctatggtgcatccagtttgcaaagtggggtcccatcaaggttcagtggcagtggatctgggacagatttcactctcaccatcagcagtctgcaacctgaagattgtgcaacttactactgtcaacagagttacagtaccccggtcactttcggccctgggaccaaagtggatatcaaac

SEQ ID NO: 233 - DNA, 346 bp, Artificial Sequence
  Synthetic
gaggtgcagctggtggagtctggaggaggcttgatccagcctggggggtccctgagactctcctgtgcagcctctgggttcaccgtcagtagcaactacatgaactgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagtcgtacctgggaatgaggactggggccagggaaccctggtcaccgtctcctcag

SEQ ID NO: 234 - DNA, 325 bp, Artificial Sequence
  Synthetic
gaaattgtgttgacacagtctccagccaccctgtctttgtctccaggggaaagagccaccctctcctgcagggccagtcagagtgttagcagctacttagcctggtaccaacaaaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcccgaaggcactttcggcggagggaccaaggtggagatcaaac

SEQ ID NO: 235 - DNA, 354 bp, Artificial Sequence
  Synthetic
gaggtgcagctggtggagtctggaggaggcttgatccagcctggggggtccctaagactctcctgtgcagcctctggggtcaccgtcagaagtaattacatgagctgggtccgccaggctccagggaaggggctggagtgggtctcagtaatttatagcggtggtagcacattctacgcagactccgtgaagggccgattcaccatctccagagacaattccaagaacacgctgtatcttcaaatgaacagcctgagagccgaggacacggccgtgtattactgtgcgaggggggggggccactactacggtatggacgtctggggccaagggaccacggtcaccgtctcctca

SEQ ID NO: 236 - DNA, 325 bp, Artificial Sequence
  Synthetic
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctccgtacacttttggccaggggaccaagctggagatcaaac

SEQ ID NO: 237 - DNA, 376 bp, Artificial Sequence
  Synthetic
gaggtgcagctggtggagtctgggggaggcttggtccagcctggggggtccctgagactctcctgtgcagcctctggattcaccttcagtagctatgctatgcactgggtccgccaggctccagggaagggactgcaatatgtttcagctattagtagtaatgggggtagtacatattatgcaaactctgtgaagggcagattcaccatctccagagacaattccaagaacacgctgtatcttcaaatgggcagcctgagagctgaggacatggctgtgtattactgtgcgagagatggttgtagtagtaccagctgccccgaaataaactggttcgacccctggggccagggaaccctggtcaccgtctcctcag

SEQ ID NO: 238 - DNA, 325 bp, Artificial Sequence
  Synthetic
tcctatgagctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatggtagtagtgatcatgtggtcttcggcggagggaccaagctgaccgtcctag

SEQ ID NO: 239 - DNA, 376 bp, Artificial Sequence
  Synthetic
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggaatatctattatagtgggatcacctactacaacccgtccctcaagagtcgagtcaccatatccgtagacacgtccaagagccagttctccctgaacctgagctctgtgaccgccgcagacacggctgtgtattactgtgcgagacgcggtagagtctacggtggtaactcggggaatgcttttgatatctggggccaagggacaatggtcaccgtctcttcag

SEQ ID NO: 240 - DNA, 325 bp, Artificial Sequence
  Synthetic
cagtctgccctgactcagcctgcctccgtgtctgggtctcctggacagtcgatcaccatctcctgcactggaaccagcagtgatgttgggagttatgaccttgtctcctggtaccaacagcacccaggcaaatcccccaaactcatgatttatgaggtcattaagcggccctcaggggtttctaatcgcttctctggctccaagtctggcaacacggcctccctgacaatctctgggctccaggctgaggacgaggctgattattactgctgctcatatgcaggtagttgggtgttcggcggagggaccaagctgaccgtcctag

SEQ ID NO: 241 - DNA, 358 bp, Artificial Sequence
  Synthetic
caggtgcagctgcaggagtcgggcccaggactggtgaagccttcggagaccctgtccctcacctgcactgtctctggtgactccatcagtagatactactggagttggatccggcagcccccagggaagggactggagtggattgggtattcccattacagtgggagcaccaactacaacccctccctcaagagtcgagtcagcctttcattagacacgtccaagaaccacctctccctgaagctgagctctgtgaccgctgcggacacggccgtgtattattgtgcgagagcgcattattatgtcactagtgattttgactactggggccagggaaccctggtcaccgtctcctcag

SEQ ID NO: 242 - DNA, 334 bp, Artificial Sequence
  Synthetic
cagtctgtgctgactcagccaccctccgcgtctgggacccccgggcagagggtcaccatcgcttgttctggaagcagctccaacatcggaagtaatagtgtaaactggttccagcagctcccaggaacggcccccaaactcctcatctatagtgataatcagcggccctcaggggtccctgaccgattctctggctccaagtctggcacctcagcctccctggccatcagtgggctccagtctgaggatgaggctgattattactgtgcagcatgggatgacagcctgaatggccatgtggtattcggcggagggaccaagctgaccgtcctag

SEQ ID NO: 243 - DNA, 361 bp, Artificial Sequence
  Synthetic
caggtgcagctggtgcagtctggggctgaggtgaagaagcctggggcctcagtgaaggtttcctgcaaggcatctggatacaccttcaccagctactatatacactgggtgcgacaggcccctggacaagggcttgagtggatgggaataatctaccctagtggaggcagcagaaggtacgcacagaagttccagggcagagtcaccatgaccagggacacgtccacgagcacagtcaacatggagctgaacagcctgagatccgaggacacggccgtatattactgtgcgagagagggctcaactggaactacgttccttgactactggggccagggaaccctggtcaccgtctcctcag

SEQ ID NO: 244 - DNA, 328 bp, Artificial Sequence
  Synthetic
tcctatgagctgacacagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcacgtgtgggatggtagtagtgatcatcatgtggtattcggcggagggaccaagctgaccgtcctag

SEQ ID NO: 245 - DNA, 375 bp, Artificial Sequence
  Synthetic
caggtgcagctggtgcagtctggggctgaggtgaagaagcctgggtcctcggtgaaggtctcctgcaaggcttccggaggcagcttcagcaactatgctatcagctgggtgcgacaggccccgggacaagggcttgagtggatgggagggatcatccctttctctggtacagcaaactacgcacagaagttccagggcagagtcacgattaccgcggacgaagccacgagcacagcctacatggagctgagtagcctgagatctgaggacacggccgtgtattactgtgcgagagatgattacggtacactatgggcacactactactacggtatggtcgtctggggccaagggaccacggtcaccgtctcctca

SEQ ID NO: 246 - DNA, 329 bp, Artificial Sequence
  Synthetic
caggctgtggtgactcaggagccatcgttctcagtgtcccctggagggacagtcacactcacttgtggcttgagctcgggctcagtttctactagttactaccccagctggttccagcagaccccaggccaggctccacgcacgctcatctacagcacaaacactcgctcttctggggtccctgatcgcttctctggctccgtccttgggaacaaagctgccctcaccatcacgggggcccagtcagatgatgaatctgattattactgtgtattgtatatgggtagtggcaaggtggttttcggcggagggaccaagctgaccgtcct

SEQ ID NO: 247 - DNA, 379 bp, Artificial Sequence
  Synthetic
gaggtgcagctgttggagtctgggggaggcttggtacagcctggggggtccctgagactctcctgtgcagcctctggattcgcctttatcacctatgccatgacctgggtccgccaggctccagggaaggggctggagtgggtctcaattattagtgctagtggtggtagtacatactacgcagactccgtgaagggccggttcaccatctccagagacaattccgagaacacgctgtatctgcaaatgagcagcctgagagccgaggacacggccgtatatttctgtgcgaaagtaacttttcgaacggagttgacgcaggtggtacctaactactttgacttctggggccagggaaccctggtcaccgtctcctcag

SEQ ID NO: 248 - DNA, 322 bp, Artificial Sequence
  Synthetic
gaaattgtgttgacacagtctccagccaccctgtctttgtctccaggggaaagagccaccctctcctgcagggccagtcagagtgttaacacctacttagcctggtaccaacagaaacctggccaggctcccaggctcctcatctatgatgcatccaacagggccactggcatcccagccaggttcagtggcagtgggtctgggacaggcttcactctcaccatcagcagcctagagcctgaagattttgcagtttattactgtcagcagcgtaccaactggccgctcactttcggcggagggaccaaggtggaaatcaaac

SEQ ID NO: 249 - DNA, 361 bp, Artificial Sequence
  Synthetic
caggtgcagctggtggagtctgggggaggcgtggtccagcctgggaggtccctgagactctcctgtgcagcctctggattcaccttcagtacctatgccatgcactgggtccgccaggctccaggcaaggggctggagtgggtggcagttatattatatgatggaagttataaatcctatgcagactccgtgaagggccgattcaccatctccagagacaattccaagagcacgctgtatctgcacatgaacagcctgagagctgaggacacggctgtgtattactgtgcgacagatgagggcgaggctacaacgtatcctggctactggggccagggaaccctggtcaccgtctcctcag

SEQ ID NO: 250 - DNA, 325 bp, Artificial Sequence
  Synthetic
gacatccagatgacccagtctccatcctccctgtctgcatctgtaggagacagagtcaccatcacttgccgggcaagtcagagcattagcaggtatttaaattggtatcagcagaaaccagggaaagcccctaacctcctgatctatgctgcatccaatttgcaaagtggggtcccatcaaggttcagtggcagtggatctgggacagatttcactctcaccatcagcagtctgcaacctgaagattttgcaacttactactgtcaacagagttacagtacccccccctggacgttcggccaagggaccaaggtggaaatcaaac

SEQ ID NO: 251 - DNA, 381 bp, Artificial Sequence
  Synthetic
caggtgcagctggtggagtctgggggaggcgtggtccagcctgggaggtccctgagactctcgtgtgcagcctctggattcaccttcagtagctatggcatgcactgggtccgccaggctccaggcaaggggctggagtgggtggcagttatatcaagtgatgcaagtaatacatactttgcagactccgtgaagggccgattgaccatctccagagacaactccaagaacatactgtttctgcaaatgaacagcctgagaactgaggacacagctgtgtattactgtgcgaaatcgcatagtactgcttattccccctctactttctactactacggtttggacgtctggggccaggggaccacggtcaccgtctcctca

SEQ ID NO: 252 - DNA, 325 bp, Artificial Sequence
  Synthetic
gacatccagatgacccagtctccatcctccctgtctgcatctgttggagacagagtcaccatcacttgccgggcaagtcagagcattgacagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttacttctgtcaacagagttacagtacccccccattcactttcggccctgggaccaaagtggatatcaaac

SEQ ID NO: 253 - DNA, 382 bp, Artificial Sequence
  Synthetic
gaggtgcagctggtggagtctgggggaggcttggtaaagccagggcggtccctaagactctcctgtacaacttctggattcacctttggtgattatactatgagctggttccgccaggctccagggaaggggctggagtgggtaggtttcattagaaccgaagctttcggtgggacaacagaatacgccgcgtctgtgaaaggcagattcaccatctcaagagatgattccaaaagcatcgcctttctgcaaatgaacagcctgaaaaccgaggacacagccgtctattactgtactagaaggatcatgtattactctgataatagtggttcccgcacctttgactactggggccagggaaccctggtcaccgtctcctcag

SEQ ID NO: 254 - DNA, 319 bp, Artificial Sequence
  Synthetic
gaaatagtgatgacgcagtctccagccaccctgtctgtgtctccaggggaaagcgtcaccctctcctgcagggccagtcagagtgttagcagcaacttagcctggtaccagcagaaacctggccaggctcccaggctcctcatctatggtgcagctatcagggccactggtatcccagccaggttcagtggcagtgggtctgggacagagttcactctcaccatcagcagcctgcagtctgaagattttgcactttattactgtcagcagtataataactggtggacgttcggccaagggaccaaggtggaaatcaaac

SEQ ID NO: 255 - DNA, 382 bp, Artificial Sequence
  Synthetic
caggtgcagctggtggagtctgggggaggcgtggtccagcctgggaggtccctgagactctcctgtgcagcctctggattcaccttcagtcactatggcatgtactgggtccgccaggctccaggcaaggggctggagtgggtggcagttatatcatatgatggaagtaataaatactatgcagactccgtgaagggccgattcaccatctccagagacaattccaagaacacgctgtatgtgcaaatgaacagcctgagagctgaggacacggctgtatattattgtgcgaagaacgcgggcccctattgtagtgctcataactgctactcgggaccctttgactactggggccagggaacactggtcaccgtctcctcag

SEQ ID NO: 256 - DNA, 319 bp, Artificial Sequence
  Synthetic
gacatccagatgacccagtctccatcctccctgtctgcatctgtaggagacagagtcaccatcacttgccaggcgagtcaggacattagcaactatttaaattggtatcagcataaaccagggaaagcccctaagctcctgatctacgatgcatccaatttggaaacaggggtcccatcaaggttcagtggaagtggatctgggacagattttactttcaccatcaccagcctgcagcctgaagattttgcaacatattactgtcagcagtattataatctccccggtttcggccctgggaccaaagtggatatcaaac

SEQ ID NO: 257 - DNA, 379 bp, Artificial Sequence
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctatatggagctgagcagcctgagatctgaggacacggccgtatattactgtgcgagagtaggtgatagtggtggttattaccccgccggtttggactactttgactactggggccagggaaccctggtcaccgtctcctcag

SEQ ID NO: 258 - DNA, 331 bp, Artificial Sequence
  Synthetic
gaaattgtgttgacgcagtctccaggcaccctgtctttgtctccaggggaaagagccaccctctcctgcagggccagtcagagtgttagcagtgattatttagcctggtaccagcagaaacctggccaggctcccaggctcctcatctatgctgcatccagcagggccactggcatcccagacaggttcagtggcagtgggtctgggacagacttcactctcaccatcagcagactggagcctgaagattttgcagtgtattactgtcagcagtatggtagctcacctcccttcgtggcgttcggccaagggaccaaggtggaaatcaaac

SEQ ID NO: 259 - DNA, 363 bp, Artificial Sequence
  Synthetic
caggtgcagctggtgcagtctggggctgaggtgaagaagcctgggtcctcggtgaaggtctcctgcaaggcttctggaggcaccttcagcagcaatgctatcaactgggtgcgacaggcccctggacaagggcttgagtggatgggagggatcatccctatctttggtacagtaaactacgcacagaacttccagggcagagtcacgattaccgcggacgaatccacgagcacagcccacatggagctgagcagcctgagatctcaagacacggccgtgtattactgtgcgagagatacggtggtaagtcccttatacggtttggacgtctggggccaagggaccacggtcaccgtctcctca

SEQ ID NO: 260 - DNA, 325 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatggtgcaaccagtttgcaaagtggggtcccatcaaggttcagtggcagtggatctgggacagatttcactctcaccatcagcagtctgcaacctgaagattttgcaacttactactgtcaacagagttacagtacccctcgaatcattttcggccctgggaccaaagtggatatcaaac

SEQ ID NO: 261 - DNA, 382 bp, Artificial Sequence
  Synthetic
caggtgcagctggtggagtctgggggaggcgtggtccagcctgggaggtccctgagactctcctgtacagtctctggattcaccttcagtagatatggcatgcactgggtccgccaggctccaggcagggggctggagtgggtggcagttatatcatatgatggagataatagatactatgcagactccgtgaagggccgattcaccatctccagagacaattccaagaacacgctgtatctgcaaatgaacagcctgagagctgaggacacggctgtgtattactgtgcgaaaaaaagcggcctatattgtggtggtagtagctgccactccggaacatttgactactggggccagggaaccctggtcaccgtctcctcag

SEQ ID NO: 262 - DNA, 322 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccctggccttcggccaagggacacgactggagattaaac

SEQ ID NO: 263 - DNA, 370 bp, Artificial Sequence
  Synthetic
caggtgcagctggtggagtctgggggaggcgtggtccagcctgggaggtccctgagactctcctgtgcagcctctggattcactttcagtaattatggcatgtactgggtccgccaggctccaggaaaggggctggagtgggtggcacttatatcatatgatggaagtgataaatactatgcagactccgtgaagggccgaatcaccatctccagagacaattccaagaacaccctatatctgcaaatgaacagcctgagagctgaggacacggctgtgtataactgtgcgaaatgtttctacagctatggttacccttgttactactttgactactggggccagggaaccctggtcaccgtctcctcag

SEQ ID NO: 264 - DNA, 334 bp, Artificial Sequence
  Synthetic
aattttatgctgactcagccgcactctgtgtcggagtctccggggaagacggtaaccatctcctgcacccgcagcagtggcagcattgccagcaactatgtgcagtggtaccagcagcgcccgggcagtgcccccaccaatgtgatctatgaggataaccaaagaccctatggggtccctgatcggttctctggctccattgacagctcctccaactctgcctccctcaccatctctggactgaagactgaggacgaggctgactactactgtcagtcttgtgatagcaacaacctctgggtgttcggcggagggaccaagctgaccgtcctag

SEQ ID NO: 265 - DNA, 388 bp, Artificial Sequence
  Synthetic
caggtgcagctggtggagtctgggggaggcgtggtccagcctgggaggtccctgagactctcctgtgcagcgtctggattcaccttcagtaactttgccattcactgggtccgccaggctccaggcaaggggctggagtgggtggcagttctttggtatgatggaaggaataaagattatgcagactccgtgaagggccgattcaccatctccagagacaattccaacaacacgctgtatctgcaaatgagcagcctgagagccgaggacacggctgtgtattactgtgcgagagaactatattactatgatagaagtggttattatggtcccgatgattatgcttttgatatctggggccaagggacaatggtcaccgtctcttcag

SEQ ID NO: 266 - DNA, 322 bp, Artificial Sequence
  Synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttacaaagtggggtcccatcaaggttcagcggcagtggatctgggacagagttctctctcaccatcagcagcctgcagcctgatgattttgcaacttattactgccaacactataatagttattggaggacgttcggccaagggaccaaggtggaaatcaaac

SEQ ID NO: 267 - DNA, 364 bp, Artificial Sequence
  Synthetic
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcacttatttatagcggtggtagcacatactacgcagactccgtgaagggccgattcaccatctccagagacaattccaagaacacggtgcatcttcaaatgaacagcctgagagccgaggatacggccgtgtattactgtgcgagaccccgatatggttcgaggagttactacgccggcgactactggggccagggaaccctggtcaccgtctcctcag

SEQ ID NO: 268 - DNA, 322 bp, Artificial Sequence
  Synthetic
gacatccagatgacccagtctccatcctccctgtctgcatttgtaggagacagagtcaccatcacttgccaggcgagtcaggacattaacaactatttaaattggtatcagcagaaaccagggaaagcccctaagctcctgatctacgatacatccaatttggaaataggggtcccatcaaggttcagtggaagtggatctgggacatattttactttcaccatcagcagcctgcagcctgaagatattgcaacttattactgtcaacagtatgataatctcccaatcaccttcggccaagggacacgactggagattaaac

SEQ ID NO: 269 - DNA, 355 bp, Artificial Sequence
  Synthetic
gaggtgcagctggtggagtctggaggaggcttaatccagcctggggggtccctgagactctcctgtgcagcctctgggatcatcgtcagtaggaactacatgacctgggtccgccaggctccagggaaggggctggagtgggtctcagttatttatagcggtggtagcacattctacgcagactccgtgaagggccgattcaccatctccagagacaattccaagaacacgttgtatcttaaaatgaacaacctgagagccgaggacacggccgtgtattactgtgcgagagatctcggagcagcgggggcgttggacttctggggccagggaaccctggtcaccgtctcctcag

SEQ ID NO: 270 - DNA, 325 bp, Artificial Sequence
  Synthetic
gaaattgtgttgacgcagtctccaggcaccctgtctttgtctccaggggaaagagccaccctctcctgcagggccagtcagagtgttagcagcaccttcttagcctggtaccagcagaaacctggccaggctcccaggctcctcatctatggtgcatccagcagggccactggcatcccagacaggttccgtggcagtgggtctgggacagacttcactctcaccatcagcagactggagcctgaagattttgcagtgtattactgtcagcagtatggtagctcaccggacacttttggccaggggaccaagctggagatcaaac

SEQ ID NO: 271 - DNA, 364 bp, Artificial Sequence
  Synthetic
gaggtgcagctggtggagtctgggggaggcttggtccagcctggggggtccctgagactctcctgttcagcctctggattcaccttcagtagctatgctatgcactgggtccgccaggctccagggaagggactggaatatgtttcatctattactagtgatggggttggcacatactacgcagactccgtgaagggcagattcaccatctccagagacaattccaagaacactctgtatcttcaaatgagaagtctgagagctgaggacacggctgtgtattactgtgtgagcgactctccgacaactatggttactatttttgactactggggccagggaaccctggtcaccgtctcctcag

SEQ ID NO: 272 - DNA, 322 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgttgcatccagtttgcaaagtggggtcccatcaaggttcagtggcagtggatctgggacagatttcactctcaccatcagcagtctgcaacctgaagattttgcaacttactactgtcaacagagttacagtagtctgctcactttcggcggagggaccaaggtggagatcaaac

SEQ ID NO: 273 - DNA, 361 bp, Artificial Sequence
  Synthetic
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggccgtgtattactgtgcgagagggaggttgggagtcgtattaggcgtagactactggggccagggaaccctggtcaccgtctcctcag

SEQ ID NO: 274 - DNA, 331 bp, Artificial Sequence
  Synthetic
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctag

SEQ ID NO: 275 - DNA, 357 bp, Artificial Sequence
  Synthetic
gaggtgcagctggtgcagtctggagcagaggtgaaaaagcccggggagtctctgaagatctcctgtaagggttctggatacagctttaccagttattggatcggctgggtgcgccagatgcccgggaaaggcctggagtggatggggatcatctatcctggtgactctgataccagatacagcccgtccttccaaggccaggtcaccatctcagccgacaagtccatcagcaccgcctacttgcagtggcgcagcctgaaggcctcggacaccgccatgtattactgtgcgagacacgacagtagttatgttccccctggactctggggccagggaaccctggtcaccgtctcctca

SEQ ID NO: 276 - DNA, 331 bp, Artificial Sequence
  Synthetic
cagtctgtgctgactcagccaccctcagcgtctgggacccccgggcagagggtcaccatctcttgttctggaagcagctccaacatcggaagtaattctgtaaactggtaccaccagctcccaggaacggcccccaaagtcctcatatgttataataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtcctag

SEQ ID NO: 277 - DNA, 360 bp, Artificial Sequence
  Synthetic
gaggtgcagctggtgcagtctggagcagaggtgaaaaagcccggggagtctctgaagatctcctgtaagggttctggatacagttttatcagccactggatcggctgggtgcgccagatgcccgggaaaggcctggagtggatggggatcatctatcctggtgactctgataccaaatacagcccgtccttccaaggccaggtcaccatctcagccgacaagtccatcagcaccgcctacctgcagtggagcagcctgaaggcctcggacaccgccatgtattactgtgcgagaatctatagcagcagtgataacggtatggacgtctggggccaagggaccacggtcaccgtctcctca

SEQ ID NO: 278 - DNA, 331 bp, Artificial Sequence
  Synthetic
cagtctgtgctgactcagccaccctcagcgtctgggacccccgggcagagggtcaccatctcttgttctggaagcagctccaacatcggaagtaatcctgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccaagctgaccgtcctag

SEQ ID NO: 279 - DNA, 352 bp, Artificial Sequence
  Synthetic
gaggtgcagctggtggagtctggaggaggcttgatccagcctggggggtccctgagactctcctgtgcagtctctggcttcaccgtcagtcgcaactacttgaactgggtccgccaggctccagggaaggggctggagggggtctcaattatttatcccggtggtagcacattctacgcagactcccttaagggccgattcaccatctccagagacaattccaagaacacgctgtatcttcaaatgaacagcctgagagccgaggactcggccgtctattactgtgcgagatcgtacggcgattactacttagatttctggggccagggaaccctggtcaccgtctcctcag

SEQ ID NO: 280 - DNA, 322 bp, Artificial Sequence
  Synthetic
gaaattgtgttgacgcagtctccaggcaccctgtctttgactccaggggaaagagccaccctctcctgcagggccagtcagagtgttagcagcagctacttatcctggtaccagcagaaacctggccaggctcccaggctcctcttctatggtgcatccggcagggccactggcatcccagacaggttcagtggcagcgggtctgggacagacttcactctcaccatcaacagactggagcctgaagattttgcagtgtattactgtcagcactatggtagaacgtggacgttcggccaagggaccaaggtggaaatcaaac

SEQ ID NO: 281 - DNA, 352 bp, Artificial Sequence
  Synthetic
gaggtgcagctggtggagtctggaggaggcttgatccagcctggggggtccctgagactctcctgtgcagcctctgatttcatcgtcagtagcaactacatgagctgggtccgccaggctccagggaaggggctggaatgggtctcagttatttatagcggtggtagcacatactacgcagactccgtgaagggccgattcaccatctccagagacaattccaagaacacgctgtatcttcaaatgaacagcctgagagtcgaggacacggccgtgtattactgtgcgagagattggggggataactattttgactactggggccagggaaccctggtcaccgtctcctcag

SEQ ID NO: 282 - DNA, 325 bp, Artificial Sequence
  Synthetic
gaaattgtgttgacgcagtctccaggcaccctgtcattgtctccaggggaaagagccaccctctcctgcagggccagtcagagtcttagcagcaggttcttagcctggtaccagcagaaacctggccaggctcccaggctcctcatctatgatgcatccagcagggccactggcatcccagacaggttcaggggcagtgggtctgagacagacttcactctcaccatcagcagactggagcctgaagatttcgcagtgtattactgtcagcagtatggtagctcacctcggacgttcggccaagggaccaaggtggaaatcaaac

SEQ ID NO: 283 - DNA, 361 bp, Artificial Sequence
  Synthetic
gaggtgcagctggtgcagtctggagcaggggtgaaaaggcccggggagtctctgaagatctcctgtaagacctctggatacagctttaccaactactggatcagctgggtgcgccagatgcccggaaaaggcctggagtggatgggggcgattgatcctcgtgattctgaaaccagatacagcccgtccttccaaggccaggtcaccatctcagccgacaagtccatcagcaccgcctacctgcagtggagcagcctgaagacctccgacaccgccacgtattactgcgcgaaaggcccccccccgtcctgggggggctttgaccagtggggccagggagtcctggtcaccgtctcctcag

SEQ ID NO: 284 - DNA, 337 bp, Artificial Sequence
  Synthetic
gatgttgtgatgactcagtctccactctccctggccgtcacccttggacagccggcctccatctcctgcacgtctagtcaaagcctcgtatacagtgatggaagcacctacttgaattggtttcatcagaggccaggccaatctccaaggcgcctcatttataaggtttctaatcgggactctggggtccctgacagattcagcggcagtgggtcagtcactgatttcacactgaaaatcagcagggtggaggctgaggatgttgggatttattactgcatgcaaggtacacactggcctccgacttttggccaggggaccaagctggagatcaaac

SEQ ID NO: 285 - DNA, 382 bp, Artificial Sequence
  Synthetic
caggtgcagctggtggagtctgggggaggcgtggtccagcctgggaggtccctgagactctcctgtgcagcctctggattcacattcagtagctatggcatgcactgggtccgccaggctccaggcaaggggctggagtgggtggcagttatatcatatgatggaagtgataaatactatgcagactccgtgaagggccgattcaccatctccagagacaattccaagaacacgctgtttctgcaaatgaacagcctgagagctgaggacacggctgtgtattactgtgcgaaacagatttcaagatattgtggtggtggtagctgctactccttgaccattgactactggggccagggaaccctggtcaccgtctcctcag

SEQ ID NO: 286 - DNA, 322 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgatcaccttcggccaagggacacgactggagattaaac

SEQ ID NO: 287 - DNA, 345 bp, Artificial Sequence
  Synthetic
gaggtgcagctggtggagtctggaggaggcttgatccagcctggggggtccctgagactctcctgtgcagcctctggactcatcgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagtgtgagagccgaggacacggccgtgtattactgtgcgagagaagtctacggtatggacgtctggggccaagggaccacggtcaccgtctcctca

SEQ ID NO: 288 - DNA, 322 bp, Artificial Sequence
  Synthetic
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatatttaccctccacctttcggccctgggaccaaagtggatatcaaac

SEQ ID NO: 289 - DNA, 351 bp, Artificial Sequence
  Synthetic
gaggtgcagctggtggagtctggaggaggcttgatccagcctggggggtccctgagactctcctgtgcagcctctggggtcaccgtcagtagcaactacatgacctgggtccgccaggctccagggaaggggctggagtgggtctcagttatttatagcggtggtagtacatactacgcagactccgtgaagggccgattcaccatctccagagacaattccaagaacacgctgtatcttcaaatgaacagcctgagagccgaggacacggccgtgtattactgtgcgagatcgcttgaggcgtacggtatggacgtctggggccaagggaccacggtcaccgtctcctca

SEQ ID NO: 290 - DNA, 322 bp, Artificial Sequence
  Synthetic
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttacgggtacacttttggccaggggaccaagctggagatcaaac

SEQ ID NO: 291 - DNA, 373 bp, Artificial Sequence
  Synthetic
caggttcagctggtgcagtctggacctgaggtgaagaagcctggggcctcagtgaaggtctcctgcaaggcttctggttacacctttaccagctatggtatcagctgggtgcgacaggcccctggacaagggcttgagtggatgggatggatctccacttacaatggtaacacaaactatgcacagaagctccagggcagagtcaccatgaccacagactcatccacgagcacagcctacatggaactgaggagcctgagatctgacgacacggccgttttttactgtgcgagagtgggcacatattactctgatagtagtgcttattacttcgactactggggccagggaaccctggtcaccgtctcctcag

SEQ ID NO: 292 - DNA, 328 bp, Artificial Sequence
  Synthetic
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatgataactggccccctatattcactttcggccctgggaccaaagtggatatcaaac

SEQ ID NO: 293 - DNA, 373 bp, Artificial Sequence
  Synthetic
gaggtgcagctggtggagtctggaggaggcttgatccagcctggggggtccctgagactctcctgtgcagcctctgggttcaccgtcaggagcggctacatgagctgggtccgccaggctccagggaaggggctggagtgggtctcagctatttatagcggtagtagcacatactacgcagactccgtgaagggccgattcaccatctccagagacaattccaagaacacgctgtatcttcaaatgaacagcctgcgagccgaagacacggccatgtattattgtgcgagattcattccccccgatagtcgtggttattcgtcgggggcttttgatatctggggccaagggacaatggtcaccgtctcttcag

SEQ ID NO: 294 - DNA, 331 bp, Artificial Sequence
  Synthetic
cagtctgccctgactcagcctgcctccgtgtctgggtctcctggacagtcgatcaccatctcctgcactggaaccagcagtgatgttgggacttatgaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttgggtgttcggcggagggaccaagctgaccgtcctag

SEQ ID NO: 295 - DNA, 385 bp, Artificial Sequence
  Synthetic
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtactactgtgcgagaacattgagttactatgatagtagtggtacattactgtatgaggactactttgactactggggccagggaaccctggtcaccgtctcctcag

SEQ ID NO: 296 - DNA, 334 bp, Artificial Sequence
  Synthetic
cagtctgtgctgactcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttgggtgttcggcggagggaccaagctgaccgtcctag

SEQ ID NO: 297 - DNA, 370 bp, Artificial Sequence
  Synthetic
caggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaaccctagtggtggtgccacaacctacgcacagaagttccagggcagagtcaccatgaccggggacacgtccacgaggacagtctacatggaactgagcagcctgagatctgaggacacggccgtgtattactgtgcgagaggaggcagcccgattccggccccggggagtgattttgactactggggccagggaaccctggtcaccgtctcctcag

SEQ ID NO: 298 - DNA, 334 bp, Artificial Sequence
  Synthetic
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtaggagcactttcgtggtattcggcggagggaccaagctgaccgtcctag

SEQ ID NO: 299 - DNA, 391 bp, Artificial Sequence
  Synthetic
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttgatacaacaaactacgcacagaagttccagggccgagtctcgattaccgcggacgaatccacgagcacttcctacatgcagctgagcagcctgagatctgaggacacggccgtgtattattgtgcgagagtacgggggaccgccgccgcaggtcctaacgagcatatagcagcagctggtacttttgactactggggccagggaaccctggtcaccgtctcctcag

SEQ ID NO: 300 - DNA, 340 bp, Artificial Sequence
  Synthetic
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgagtcagtggcagcgggtctgggacagatttcactctcaccatcagcagcctgcaggctgaagatgtggcagtttattactgtcagcaatattatagtactcagatcaccttcggccaagggacacgactggagattaaac

SEQ ID NO: 301 - DNA, 364 bp, Artificial Sequence
  Synthetic
caggtgcagctggtgcagtctggggctgaggtgaagaagcctgggtcctcggtgaaggtctcctgcaaggcttctgggggcaccttcagcagctatgctatcagctgggtgcgacaggcccctggacaaggacttgagtggatgggaggagtcatccctctctttggtacagcaaactacgcacagaagttccagggcagagtcacgattaccgcggacaaatccacgaacacagcctacatggagctgagcagcctgagatctgaagacacggccgtgtattactgtgcgagaggtggaggtagtagtggttataactggttcgacccctggggccagggaaccctggtcaccgtctcctcag

SEQ ID NO: 302 - DNA, 322 bp, Artificial Sequence
  Synthetic
gacatccagatgacccagtctccatcctccctgtctgcatctgtaggagacagagtcaccatcacttgccgggcaagtcagagcattaacaactttttaaattggtatcagcaaaaaccagggaaagcccctaagctcctgatctatgctgcatccactttgcaaagtggggtcccatcaaggttcagtggcagtggatctgggacagatttcactctcaccatcagcagtctgcaacctgaagattttgcatcttactactgtcaacagagttccagtatcttgtacacttttggccaggggaccaagctggagatcaaac

SEQ ID NO: 303 - DNA, 382 bp, Artificial Sequence
  Synthetic
caggtgcagctggtgcagtctggggctgaggtgaagaagcctggggcctcagtgaaggtctcctgcaaggcttctggatacaccttcaccagttatgatattaactgggtgcgacaggccactggacaagggcttgagtggatgggatggatgaaccctatcagtggtaacacaggctatgcacagaagttccagggcagagtcaccatgaccaggaatacctccataagcacagcctacatggagctgagcagcctgagatctgaggacacggccgtgtattactgtgcgagaggcgggagatattgtagtggtgatagctgctactccaatatctggttcgacccctggggccagggaaccctggtcaccgtctcctcag

SEQ ID NO: 304 - DNA, 325 bp, Artificial Sequence
  Synthetic
gacatccagttgacccagtctccatccttcctgtctgcatctgtaggagacagagtcaccatcacttgccgggccagtcagggcattagcaattatttagcctggtatcagcaaaaaccagggaaagcccctaaggtcctgatctatgctgcatccactttgcaaagtggggtcccatcaaggttcagcggcagtggatcagggacagaattcactctcacaatcagcagcctgcagcctgaagattttgcaacttattactgtcaacagcttaatagttaccccgggatcaccttcggccaagggacacgactggagattaaac

SEQ ID NO: 305 - DNA, 378 bp, Artificial Sequence
  Synthetic
gaggtgcagctggtggagtctgggggaggcttggtacagcctggggggtccctgagactctcctgtgcagcctctggattcaccttcagtaggtacgacatgcactgggtccgccaacctacaggaaaaggtctggagtgggtctcaactcttgatactgctggtgacccatactatgcaggctccgtgaagggccgattcaccatctccagagaaaatgccaagaacaccttgtatcttcaaatgaacagcctgagagccggggacacggctgtgtattactgtgcaagagagaggcgctactatgatagtagtggttaccacaggagggacggtatggacgtctggggccaagggaccacggtcaccgtctcctca

SEQ ID NO: 306 - DNA, 323 bp, Artificial Sequence
  Synthetic
gacatccagatgacccagtctccatcctccctgtctgcatctgtaggagacagagtcaccatcacttgccaggcgagtcaggacattaccaactttttaaattggtatcagcagaaaccagggaaagcccctaggctcctgatctacgatgcatccaatttggaaccaggggtcccatcaaggttcagtggaagtggatctgggacagattttactttcaccatcagcagcctgcagcctgaagatattgcaacatattactgtcaacagtatgacaatctccctccgctcactttcggcggagggaccaaggtggagatcaa

SEQ ID NO: 307 - DNA, 382 bp, Artificial Sequence
  Synthetic
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatcatttgatggaagtcataaatactatgtagactccgtgaaggggcgattcaccatctccagagacaattccaagaaaaggctgtatctgcaaatgaacagcctgagagctgaggacacggctgtgtattactgtgcgaaacaagcggagctatattgtagtgctggtagctgctacgaggggtacattgactactggggccagggaaccctggtcaccgtctcctcag

SEQ ID NO: 308 - DNA, 325 bp, Artificial Sequence
  Synthetic
gaaattgtgttgacgcagtctccaggcaccctgtctttgtctccaggggaaagagccaccctctcctgcagggccagtcagagtgttagcaacagctacttagcctggtaccagcagaaacctggccaggctcccaggctcctcatctctggtgcatccagcagggccactggcatcccagacaggttcagtggcagtgggtctgggacagacttcactctcaccatcagcagactggagcctgaagattttgcaatatattactgtcagcagtatggtagctcacccgggacgttcggccaagggaccaaggtggaaatcaaac

SEQ ID NO: 309 - DNA, 361 bp, Artificial Sequence
  Synthetic
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaacactatgcagactctgtgaagggccgattcaccatctccagagacaattccaagaacacgctgtatctgcaaatgaacagcctgagagccgaggacacggctgtgtactactgtgcgagggactacggtgactacgtcacatacccagactactggggccagggaaccctggtcaccgtctcctcag

SEQ ID NO: 310 - DNA, 325 bp, Artificial Sequence
  Synthetic
gacatccagatgacccagtctccttcctccctgtctgcatctgtaggagacagagtcaccatcacttgccgggcaagtcagagcattagcagctatttaaattggtatcagcagaaaccagggaaagcccctaagctcctgatctatgctgcttccagtttgcaaagtggggtcccatcaaggttcagtggcagtggatctgggacagatttcactctcaccatcagcagtctgcaacctgaagattttgcaacttactattgtcaacagagttacagtacccctccttggacgttcggccaagggaccaaggtggagatcaaac

SEQ ID NO: 311 - DNA, 352 bp, Artificial Sequence
  Synthetic
gaggtgcagctggtggagtctggaggaggcctgatccagcctggggggtccctgagactctcctgtgcagcctctgggttcaccgtcagtagcaactacatgtactgggtccgccaggctccagggaaggggctggagtgggtctcagttatttttagcggtggtagtacattctacgcagactccgtgaagggccgattcaccatctccagagacagttctaagaacacactgtatcttcaaatgaacagcctgagagccgaggacacggccgtgtattactgtgcgagaggtccctatccagcagccgataactactggggccagggaaccctggtcaccgtctcctcag

SEQ ID NO: 312 - DNA, 322 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctatcaccttcggccaagggacacgactggagattaaac

SEQ ID NO: 313 - DNA, 376 bp, Artificial Sequence
  Synthetic
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctccagagtcgagttaccatatcagtagacacgtccaagaaccagttctccctgaagctgagctctgtgactgccgcagacacggccgtgtattactgtgccagagatggttgtagtggtggtagctgctactcatactggttcgacccctggggccagggaaccctggtcaccgtctcctcag

SEQ ID NO: 314 - DNA, 319 bp, Artificial Sequence
  Synthetic
gaaattgtgttgacacagtctccagccaccctgtctttgtctccaggggaaagagccaccctctcctgcagggccagtcagagtgttagcggctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcagctggagcaccttcggccaagggacacgactggagattaaac

SEQ ID NO: 315 - DNA, 373 bp, Artificial Sequence
  Synthetic
caggtgcagctggtgcagtctggggctgaggtgaagaagcctgggtcctcggtgaaggtctcctgcaaggcttctggaggcaccttcagcagctttgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagatttggagattaccatgataataggggttattcttactctgactactggggccagggaaccctggtcaccgtctcctcag

SEQ ID NO: 316 - DNA, 322 bp, Artificial Sequence
  Synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacgaacgttcggccaagggaccaaggtggaaatcaaac

SEQ ID NO: 317 - DNA, 363 bp, Artificial Sequence
  Synthetic
caggtgcagctggtgcagtctggggctgaggtgaagaagcctgggtcctcggtgaaggtctcctgcaaggcttctggaggcaccctcagcagccatgctatcagctgggtgcgacaggcccctggacaagggtttgagtggatgggagggatcatccctatctttggtacagcaaactacgcacagaagttccagggcagagtcacgattaccgcggacgaatccacgagcacagcctacatggagctgagcagcctaagatctgaggacacggccgtatattattgtgcgagagatcacgagatggctacaatttacggtatggacgtctggggccaagggaccacggtcaccgtctcctca

SEQ ID NO: 318 - DNA, 325 bp, Artificial Sequence
  Synthetic
gacatccagatgacccagtctccatcctccctgtctgcatctgtaggagacagagtcaccatcacttgccgggcaagtcagagcattggcagttatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtgcccctttattaactttcggccttgggaccaaagtggatatcaaac

SEQ ID NO: 319 - DNA, 379 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggcgccaggcaaggggctggagtgggtggcaggtatatcatatgatggaagtaataaatactatgcagactccgtgaagggccgattcaccatctccagagacaattccaagaacacgctgtacctgcaaatgaacagcctgagagctgaggacacggctgtgtattactgtgcgaaaggggggtattattattatggttcggggagttataattacggctttgactactggggccagggaaccctggtcaccgtctcctcag

SEQ ID NO: 320 - DNA, 322 bp, Artificial Sequence
  Synthetic
gacatccagatgacccagtctccatcctccctgtctgcatctgtaggagacagagtcaccatcacttgccaggcgagtcaggacattagcaactatttaagttggtatcagcagaaaccagggaaagcccctaagctcctgatctacgatgcatcctatttggaaacaggggtcccatcaaggttcagtggaagtggatctgggacagattttactttcaccatcagcagcctgcagcctgaagatattgcaacatattactgtcaacagtatgataatcttatattcactttcggccctgggaccaaagtggatatcaaac

SEQ ID NO: 321 - DNA, 370 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagaacgatcctggtattactatgatagtagtggttctgactactggggccagggaaccctggtcaccgtctcctcag

SEQ ID NO: 322 - DNA, 337 bp, Artificial Sequence
  Synthetic
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcatctcatcatgggtgttcggcggagggaccaagctgaccgtcctag

SEQ ID NO: 323 - DNA, 369 bp, Artificial Sequence
  Synthetic
gaggtgcagctggtggagtctgggggaggcttggtacagccgggggggtccctgagactctcctgtgcagcctctggattcaccttcagtagctataacatgaactgggtccgccaggctccagggaaggggctggagtgggtttcatacattggtagtactagtagtaccatatactacgcagactctgtgaagggccgattcaccatctccagagacaatgccaagaactcactgtatctgcaaatgaacagcctgagagacgaggacacggctgtgtattactgtgcgagacaccaaggctcattgtcctactactaccacggtatggacgtctggggccaagggaccacggtcaccgtctcctca

SEQ ID NO: 324 - DNA, 322 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatactgcatccagtttgcaaagtggggtcccatcaaggttcagtggcagtggatctgggacagatttcactctcaccatcagcagtctgcaacctgaagatttggcaacttactactgtcaacagagttacagtacccctagcactttcggccctgggaccaaagtggatatcaaac

SEQ ID NO: 325 - DNA, 352 bp, Artificial Sequence
  Synthetic
gaggtgcagctggtggagtctggaggaggcttgatccagcctggggggtcactgagactctcctgtgcagcctctgggttcatcgtcagtagcaactacatgagctgggtccgccaggctccagggaaggggctggagtgggtctcagttgtttatagcggtggtagcacattctacgcagactccgtgaagggccgattcaccatctccagagacaattccaagaacacgctgtatcttcaaatgaacagcctgagagccgaggacacggccgtgtattactgtgcgagggactacggtgactactactttgactactggggccagggaaccctggtcaccgtctcctcag

SEQ ID NO: 326 - DNA, 325 bp, Artificial Sequence
  Synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacttttggccaggggaccaagctggagatcaaac

SEQ ID NO: 327 - DNA, 346 bp, Artificial Sequence
  Synthetic
gaggtgcagctggtggagtctggaggaggcttgatccagcctggggggtccctgagactctcctgtgcagcctctgggttcaccgtcagtagcaactacatgagctgggtccgccaggctccagggaaggggctggagtgcgtctcagttctttatagcggtggtagctcattctacgcagactccgtgaagggccgattcaccatctccagagacaattccaagaacacactgtatcttcaaatgaacagcctgagcgccgaggacacggccatgtattactgtgcgagatgggcgcgggggttcgacccctggggccagggaaccctggtcaccgtctcctcag

SEQ ID NO: 328 - DNA, 328 bp, Artificial Sequence
  Synthetic
cagtctgccctgactcagcctgcctccgtgtctgggtctcctggacagtcgatcaccatctcctgcactggaaccagcagtgacgttggtggttataactatgtctcctggtaccaacaccgcccaggcaaagcccccaaactcatgatttatgatgtcggtactcggccctcagggatttctaatcgcttctctggctccaagtctgacaacacggcctccctgaccatctctgggctccaggctgaggacgaggctgattattactgcagctcatatacaagcagcatcccggtgttcggcggagggaccaagctgaccgtcctag

SEQ ID NO: 329 - DNA, 364 bp, Artificial Sequence
  Synthetic
gaggtgcagctggtggagtctgggggaggcttggtccagcctggggggtccctgagactctcctgttcagcctctggattcaccttcagtagctatgttatggattgggtccgccaggctccagggaagggactggaatatgtttcaggtattagcactaatggggatatcacaaactacgcagactccgtgaagggcagattcaccatctccagagacaattccaagaacactctgtatcttcaaatgagcagtctgagagctgaggacacggctgtgtattactgtgtgaaagatctcgggctgggcaccgttgactactttgactactggggccagggaaccctggtcaccgtctcctcag

SEQ ID NO: 330 - DNA, 319 bp, Artificial Sequence
  Synthetic
gacatccagatgacccagtctccatcctccctgtctgcatctgtacgagacagagtcaccatcacttgccgggcaagtcagagcattagcaactatttaagttggtttcagcagaaaccagggaaagcccctaagctcctgatctatgctgcatccactttgcaaagtggggtcccatcaaggttcagtggcagtggatctgggacagatttcactctcaccatcagcagtctgcaacctgaagattttgcaacttactactgtcaacagagttacactacggtcactttcggcggagggaccaaggtggaaatcaaac

SEQ ID NO: 331 - DNA, 361 bp, Artificial Sequence
  Synthetic
gaggtgcagctggtggagtctgggggaggcttggtccagcctggggggtccctgagactctcctgtgcagcctctggattcacctttagtagctatttgatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggccgtgtattactgtgcgagagcccgtttgggacagctgctggggtttgactactggggccagggaaccctggtcaccgtctcctcag

SEQ ID NO: 332 - DNA, 331 bp, Artificial Sequence
  Synthetic
aattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgataccagcaattgggtgttcggcggggggaccaagctgaccgtcctag

SEQ ID NO: 333 - DNA, 355 bp, Artificial Sequence
  Synthetic
gaggtgcagctggtgcagtctggagcagaggtgaaaaagcccggggagtctctgaagatctcctgtaagggttctggatacagctttatcagccactggatcggctgggttcgccagatgcccgggaaaggcctggagtggatggggatcatctatcctggtgactctgacaccagatacagtccgtccttccaaggccaggtcaccatctcagccgacaagtccatcagcaccgcctacctgcagtggagcagcctgaaggcctcggacaccgccatgtattactgtgcgagacggggcagtgcctgggaattagactactggggccagggaaccctggtcaccgtctcctcag

SEQ ID NO: 334 - DNA, 331 bp, Artificial Sequence
  Synthetic
cagtctgtgctgactcagccaccctcagcgtctgggacccccgggcagagggtcaccatctcttgttctggaagcagctccaacatcggaagtaatcctgtaaactggtaccggcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctaaatggttatgtcttcggaactgggaccaaggtcaccgtcctag

SEQ ID NO: 335 - DNA, 360 bp, Artificial Sequence
  Synthetic
gaggtgcagctggtgcagtctggagcagaggtgaaaaagcccggggagtctctgaagatctcctgtaagggttctggatacagctttaccagccagtggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgggagacaggtagcagacgccgcctccggtatggacgtctggggccaagggaccacggtcaccgtctcctca

SEQ ID NO: 336 - DNA, 331 bp, Artificial Sequence
  Synthetic
cagtctgtgctgactcagccaccctcagcgtctgggacccccgggcagagggtcaccatctcttgttctggaagcagctccaacatcggaagtaatcctgtaaactggtaccagcagctcccaggaacggcccccaaactcctcatctataataataatcagcggccctcaggggtccctgaccgattctctggctccaagtctggcacctcagcctccctggccatcagtgggctccagtctgaggatgaggctgattattactgtgcagcatgggatgacagcctgaatggtcaggtgttcggcggagggaccaagctgaccgtcctag

SEQ ID NO: 337 - protein, 16 aa, Artificial Sequence
  Synthetic
AAPYCSGGSCYDAFDI

SEQ ID NO: 338 - protein, 9 aa, Artificial Sequence
  Synthetic
QQYGSSPWT

SEQ ID NO: 339 - protein, 16 aa, Artificial Sequence
  Synthetic
AAPYCSGGSCYDAFDI

SEQ ID NO: 340 - protein, 9 aa, Artificial Sequence
  Synthetic
QQYGSSPWT

SEQ ID NO: 341 - protein, 16 aa, Artificial Sequence
  Synthetic
AAPYCSGGSCYDAFDI

SEQ ID NO: 342 - protein, 9 aa, Artificial Sequence
  Synthetic
QQYGSSPWT

SEQ ID NO: 343 - protein, 16 aa, Artificial Sequence
  Synthetic
AAPYCNGVSHYGAFDI

SEQ ID NO: 344 - protein, 9 aa, Artificial Sequence
  Synthetic
QQYGSSPWT

SEQ ID NO: 345 - protein, 16 aa, Artificial Sequence
  Synthetic
AAPDRSGGTCYDGFNI

SEQ ID NO: 346 - protein, 9 aa, Artificial Sequence
  Synthetic
QQYGSSPWT

SEQ ID NO: 347 - protein, 13 aa, Artificial Sequence
  Synthetic
ARDYGGNSNYFGY

SEQ ID NO: 348 - protein, 9 aa, Artificial Sequence
  Synthetic
QQYNNLPLT

SEQ ID NO: 349 - protein, 13 aa, Artificial Sequence
  Synthetic
ARDYGGNANYFDY

SEQ ID NO: 350 - protein, 9 aa, Artificial Sequence
  Synthetic
QQYGYLPLT

SEQ ID NO: 351 - protein, 13 aa, Artificial Sequence
  Synthetic
ARDYGGNSNYFGY

SEQ ID NO: 352 - protein, 9 aa, Artificial Sequence
  Synthetic
QQYDNLPLT

SEQ ID NO: 353 - protein, 13 aa, Artificial Sequence
  Synthetic
ARDFGGNSNYFDY

SEQ ID NO: 354 - protein, 9 aa, Artificial Sequence
  Synthetic
QQYDNLPLT

SEQ ID NO: 355 - protein, 13 aa, Artificial Sequence
  Synthetic
ARDFGGNSNYFAY

SEQ ID NO: 356 - protein, 9 aa, Artificial Sequence
  Synthetic
QQYDNLPLT

SEQ ID NO: 357 - protein, 1273 aa, Artificial Sequence
  Synthetic
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 358 - protein, 120 aa, Artificial Sequence; identical to SEQ ID NO: 9
  Synthetic

SEQ ID NO: 359 - protein, 12 aa, Artificial Sequence
  Synthetic
AQSTWLRGSFDY

SEQ ID NO: 360 - protein, 111 aa, Artificial Sequence; identical to SEQ ID NO: 10
  Synthetic

SEQ ID NO: 361 - protein, 10 aa, Artificial Sequence
  Synthetic
QSYDSTNHWV

SEQ ID NO: 362 - protein, 130 aa, Artificial Sequence
  Synthetic
QVQLQESGPGLVKPSETLSLTCTVSGGSIRSYYWSWIRQPPGRGLEWIGYIYYSGGTNYNPSLKSRVTISVDTSKNQFSLKLSSVTAADTAVYYCARAAGVRSVVAAASTYYHYYGMDVWGQGTTVTVSS

SEQ ID NO: 363 - DNA, 24 bp, Artificial Sequence
  Synthetic
araagvrsvvaaastyyhyygmdv

SEQ ID NO: 364 - protein, 109 aa, Artificial Sequence
  Synthetic
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSGWVFGGGTKLTVL

SEQ ID NO: 365 - protein, 9 aa, Artificial Sequence
  Synthetic
SSYTSSGWV

SEQ ID NO: 366 - protein, 126 aa, Artificial Sequence
  Synthetic
EVQLVESGGGLVQPGRSLRLSCAASGFTFDDYAMHWVRQAPGKGLEWVSGISWNSGTIGYADSVKGRFIISRDNAKNSLYLQMNSLRTEDTALYYCAKDMSGPDYGGIEEYGMDVWGQGTTVTVSS

SEQ ID NO: 367 - protein, 19 aa, Artificial Sequence
  Synthetic
AKDMSGPDYGGIEEYGMDV

SEQ ID NO: 368 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYSCQVWDSSSDHVVFGGGTKLTVL

SEQ ID NO: 369 - protein, 10 aa, Artificial Sequence
  Synthetic
VWDSSSDHVV

SEQ ID NO: 370 - protein, 119 aa, Artificial Sequence
  Synthetic
QVQLVQSGAEVKKPGASVKVSCKASGYSFTSYDINWVRQATGQGLEWMGWMNPNSGNRGYAQKFQGRVTMTRNTSISTAYMELSGLTSEDTAVYFCARGVGLTYYFDYWGQGTLVTVSS

SEQ ID NO: 371 - protein, 12 aa, Artificial Sequence
  Synthetic
ARGVGLTYYFDY

SEQ ID NO: 372 - protein, 108 aa, Artificial Sequence
  Synthetic
SYVLTQPPSVSVAPGQTARITCGGNSIGSKSVHWYHQKPGQAPVLVVYDDSDRPSGIPERFSGSNSGNTATLTISRVEAGDEADYYCQVWDSSTDPVVFGGGTKLTVL

SEQ ID NO: 373 - protein, 11 aa, Artificial Sequence
  Synthetic
QVWDSSTDPVV

SEQ ID NO: 374 - protein, 121 aa, Artificial Sequence
  Synthetic
QVQLVESGGGVVQPGRSLRLSCAASGFTFSSFAMHWVRQAPGKGLEWVAVISYDGSNKYYADSVKGRFTISRDNSKNTLYLQMNSLRAEDTAVYYCAREDYYDSSGSFDYWGQGTLVTVSS

SEQ ID NO: 375 - protein, 14 aa, Artificial Sequence
  Synthetic
AREDYYDSSGSFDY

SEQ ID NO: 376 - protein, 110 aa, Artificial Sequence
  Synthetic
QSVLTQPASVSGSPGQSITISCTGTSSDVGGYNYVSWYQQHPGKAPKLMTYDVSNRPSGVSNRFSGSKSGNTASLTISGLQAEDEADYYCSSYTSSSTWVFGGGTKLTVL

SEQ ID NO: 377 - protein, 10 aa, Artificial Sequence
  Synthetic
SSYTSSSTWV

SEQ ID NO: 378 - protein, 130 aa, Artificial Sequence
  Synthetic
QVQLQESGPGLVKPSETLSLTCTVSGGAISSYYWNWIRQPPGRGLEWIGYIFYSGVINYNPSLKSRVTISVDTSKNQFSLKLSSVTAADTAVYYCARAAGVRSVVAAASTHYYYYGLDVWGQGTTVTVSS

SEQ ID NO: 379 - protein, 24 aa, Artificial Sequence
  Synthetic
ARAAGVRSVVAAASTHYYYYGLDV

SEQ ID NO: 380 - protein, 109 aa, Artificial Sequence
  Synthetic
QSVLTQSASVSGAPGQSITISCTGTSSDVGVYNYVSWYQQHPDKAPKLIIYDVSNRPSGVSNRFSGSKSANTASLTISGLQAEDEADYYCSSYTSSGWVFGGGTKLTVL

SEQ ID NO: 381 - protein, 9 aa, Artificial Sequence
  Synthetic
SSYTSSGWV

SEQ ID NO: 382 - protein, 123 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKLSFGYSYGEAYFDYWGQGTLVTVSS

SEQ ID NO: 383 - protein, 16 aa, Artificial Sequence
  Synthetic
AKLSFGYSYGEAYFDY

SEQ ID NO: 384 - protein, 109 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHHYVFGTGTKVTVL

SEQ ID NO: 385 - protein, 12 aa, Artificial Sequence
  Synthetic
QVWDSSSDHHYV

SEQ ID NO: 386 - protein, 126 aa, Artificial Sequence
  Synthetic
EVQLVESGGGLVQPGRSLRLSCAASGFTFDDYAMHWVRQAPGKGLEWVSGISWNSGTIGYADSVKGRFIISRDNAKNSLYLQMNSLRAEDTALYYCAKDMSGPDYGGIEEYGMDVWGQGTTVTVSS

SEQ ID NO: 387 - protein, 19 aa, Artificial Sequence
  Synthetic
AKDMSGPDYGGIEEYGMDV

SEQ ID NO: 388 - protein, 108 aa, Artificial Sequence
  Synthetic
SYVLTQPPSVSVAPGQTARITCGGNNIGSKSVHWYQQKPGQAPVLVVYDDSDRPSGIPDRFSGSDSGNTATLTISRVEAGDEADYYCQVWDSSSDHVVFGGGTKLTVL

SEQ ID NO: 389 - protein, 11 aa, Artificial Sequence
  Synthetic
QVWDSSSDHVV

SEQ ID NO: 390 - protein, 123 aa, Artificial Sequence
  Synthetic
QVQLQESGPGLVKSSQTLSLTCTVSGGSISSGGYYWSWIRQYPGKGLEWIGYIYYSGSTYYNPSLRSRVTISVDTSKNQFSLKLSSVTAADTAVYYCARDMATVTIHDAFDIWGQGTMVTVSS

SEQ ID NO: 391 - protein, 15 aa, Artificial Sequence
  Synthetic
ARDMATVTIHDAFDI

SEQ ID NO: 392 - protein, 110 aa, Artificial Sequence
  Synthetic
QSVLTQPASVSGSPGQSITISCTGTSSDVGSYNLVSWYQQHPGKAPKLMIYEGTKRPSGVSNRFSGSKSGNTASLTISGLQAEDEADYYCCSYAGFSGVLFGGGTKLTVL

SEQ ID NO: 393 - protein, 10 aa, Artificial Sequence
  Synthetic
CSYAGFSGVL

SEQ ID NO: 394 - protein, 130 aa, Artificial Sequence
  Synthetic
QVQLQESGPGLVKPSETLSLTCTVSGGSISSYYWSWIRQPPGRGLEWIGYIYYSGGTNYNPSLKSRVTISVDTSKNQFSLKLSSVTAADTAVYYCARAAGVRSVVAAASTYYYYYGMDVWGQGTTVTVSS

SEQ ID NO: 395 - protein, 24 aa, Artificial Sequence
  Synthetic
ARAAGVRSVVAAASTYYYYYGMDV

SEQ ID NO: 396 - protein, 109 aa, Artificial Sequence
  Synthetic
QSVLTQPASVSGSPGQSITISCTGTSSDIGGYNYVSWYQQHPGKAPKLMIYDVSNRPSGVSNRFSGSKSGNTASLTISGLQAEDEADYYCSSYTSSGWVFGGGTKLTVL

SEQ ID NO: 397 - protein, 9 aa, Artificial Sequence
  Synthetic
SSYTSSGWV

SEQ ID NO: 398 - protein, 127 aa, Artificial Sequence
  Synthetic
QVQLVQSGAEVKKPGSSVKVSCKASGGTFSSYAISWVRQAPGQGLEWMGRIIPILGIANYAQKFQGRVTITADKSTSTDYMELSSLRSEDTAVYYCAREGSAHYDSSGLNAEYFQHWGQGTLVTVSS

SEQ ID NO: 399 - protein, 20 aa, Artificial Sequence
  Synthetic
AREGSAHYDSSGLNAEYFQH

SEQ ID NO: 400 - protein, 111 aa, Artificial Sequence; identical to SEQ ID NO: 18
  Synthetic

SEQ ID NO: 401 - protein, 11 aa, Artificial Sequence
  Synthetic
QSYDSSLIASL

SEQ ID NO: 402 - protein, 121 aa, Artificial Sequence
  Synthetic
EVQLVESGGGLVEPGRSLRLSCTASGFTFGDYVMSWLRQAPGKGLEWVGFIRSKTYGETTEHAASVKGRFTISRDDSKSIAYLQMSSLKTEDTAVYFCARGLRPTRKADYWGQGTLVTVSS

SEQ ID NO: 403 - protein, 12 aa, Artificial Sequence
  Synthetic
ARGLRPTRKADY

SEQ ID NO: 404 - protein, 111 aa, Artificial Sequence
  Synthetic
QSVLTQPASVSGSPGQSITISCTGTRSDVGGYNSVSWYQQHPNKAPKLMIYDVSNRPSGVSNRFSGSKSGNTASLTISGLQAEDEADYYCTSYTSSTTLDVFGTGTKVTVL

SEQ ID NO: 405 - protein, 11 aa, Artificial Sequence
  Synthetic
TSYTSSTTLDV

SEQ ID NO: 406 - protein, 121 aa, Artificial Sequence
  Synthetic
EVQLVESGGGLVEPGRSLRLSCTASGFTFGDYVMSWLRQAPGKGLEWVGFIRSKTYGETTEHAASVKGRFTISRDDSKSIAYLQMSSLKTEDTAVYFCARGLKPTRKADYWGQGTLVTVSS

SEQ ID NO: 407 - protein, 12 aa, Artificial Sequence
  Synthetic
ARGLKPTRKADY

SEQ ID NO: 408 - protein, 111 aa, Artificial Sequence; identical to SEQ ID NO: 404
  Synthetic

SEQ ID NO: 409 - protein, 11 aa, Artificial Sequence
  Synthetic
TSYTSSTTLDV

SEQ ID NO: 410 - protein, 130 aa, Artificial Sequence; identical to SEQ ID NO: 1
  Synthetic

SEQ ID NO: 411 - protein, 24 aa, Artificial Sequence
  Synthetic
ARAAGVRSVLAAASSYYYYYGLDV

SEQ ID NO: 412 - protein, 109 aa, Artificial Sequence
  Synthetic
QSVLTQPASVSGSPGQSITISCTGTSSDVGGYNYVSWYQQHPGKAPKLMIYDVSNRPSGVSNRFSGAKSGNTASLTISGLQAEDEADYYCSSYTSSGWVFGGGTKLTVL

SEQ ID NO: 413 - protein, 9 aa, Artificial Sequence
  Synthetic
SSYTSSGWV

SEQ ID NO: 414 - protein, 121 aa, Artificial Sequence; identical to SEQ ID NO: 402
  Synthetic

SEQ ID NO: 415 - protein, 12 aa, Artificial Sequence
  Synthetic
ARGLRPTRKADY

SEQ ID NO: 416 - protein, 111 aa, Artificial Sequence; identical to SEQ ID NO: 404
  Synthetic

SEQ ID NO: 417 - protein, 11 aa, Artificial Sequence
  Synthetic
TSYTSSTTLDV

SEQ ID NO: 418 - protein, 119 aa, Artificial Sequence; identical to SEQ ID NO: 13
  Synthetic

SEQ ID NO: 419 - protein, 12 aa, Artificial Sequence
  Synthetic
ARGIAALFGFDY

SEQ ID NO: 420 - protein, 112 aa, Artificial Sequence; identical to SEQ ID NO: 14
  Synthetic

SEQ ID NO: 421 - protein, 11 aa, Artificial Sequence
  Synthetic
QSYDSSNEGVV

SEQ ID NO: 422 - protein, 123 aa, Artificial Sequence
  Synthetic
QVQLVQSGAEVKKPGASVKVSCKASGYTFTSYDINWVRQGTGQGLEWMGWMSPNSGNTGYAQKFQGRVTMTRNISISTAYMELSNLRSEDTAVYYCARGALTLTTSHNWFDPWGQGTLVTVSS

SEQ ID NO: 423 - protein, 16 aa, Artificial Sequence
  Synthetic
ARGALTLTTSHNWFDP

SEQ ID NO: 424 - protein, 108 aa, Artificial Sequence
  Synthetic
SYVLTQPPSVSVAPGQTARITCGGNNIGSKNVHWYQQKPGQAPVLVVYDDNDRPSGIPERFSGSNSGNTATLTISRVEAGDEADYYCQVWDSSSDPYVFGTGTKVTVL

SEQ ID NO: 425 - protein, 11 aa, Artificial Sequence
  Synthetic
QVWDSSSDPYV

SEQ ID NO: 426 - protein, 121 aa, Artificial Sequence; identical to SEQ ID NO: 402
  Synthetic

SEQ ID NO: 427 - protein, 12 aa, Artificial Sequence
  Synthetic
ARGLRPTRKADY

SEQ ID NO: 428 - protein, 111 aa, Artificial Sequence; identical to SEQ ID NO: 404
  Synthetic

SEQ ID NO: 429 - protein, 11 aa, Artificial Sequence
  Synthetic
TSYTSSTTLDV

SEQ ID NO: 430 - protein, 130 aa, Artificial Sequence; identical to SEQ ID NO: 394
  Synthetic

SEQ ID NO: 431 - protein, 24 aa, Artificial Sequence
  Synthetic
ARAAGVRSVVAAASTYYYYYGMDV

SEQ ID NO: 432 - protein, 109 aa, Artificial Sequence; identical to SEQ ID NO: 364
  Synthetic

SEQ ID NO: 433 - protein, 9 aa, Artificial Sequence
  Synthetic
SSYTSSGWV

SEQ ID NO: 434 - protein, 118 aa, Artificial Sequence
  Synthetic
EVQLVESGGGLVQPGGSLRLSCAASEFTVSSNYMSWVRQAPGKGLEWVSLIYPGGSTYFADSVKGRFTISRDNSKNTLYLQMNSLRAEDTAVYYCARLLPGGEYFDYWGQGTLVTVSS

SEQ ID NO: 435 - protein, 12 aa, Artificial Sequence
  Synthetic
ARLLPGGEYFDY

SEQ ID NO: 436 - protein, 112 aa, Artificial Sequence
  Synthetic
QSVLTQPASVSGSPGQSITISCTGTSSDVGGYKYVSWYQQHPGKAPKLMIYEVSNRPSGVSNRFSGSKSGNTASLTISGLQAEDEADYYCSSYTSSSTPLYVFGTGTKVTVL

SEQ ID NO: 437 - protein, 12 aa, Artificial Sequence
  Synthetic
SSYTSSSTPLYV

SEQ ID NO: 438 - protein, 120 aa, Artificial Sequence
  Synthetic
QVQLVQSGAEVKKPGASVKVSCKASGYTFTSHAITWVRQAPGQGLEWMGWISANNDNTNYVQKFQGRVTMTTDTSTSTAYMELRSLRSDDTAVYYCARPLLGYYLGIDYWGQGTLVTVSS

SEQ ID NO: 439 - protein, 13 aa, Artificial Sequence
  Synthetic
ARPLLGYYLGIDY

SEQ ID NO: 440 - protein, 110 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSGNWVFGGGTKLTVL

SEQ ID NO: 441 - protein, 9 aa, Artificial Sequence
  Synthetic
QSYDSGNWV

SEQ ID NO: 442 - protein, 121 aa, Artificial Sequence
  Synthetic
EVQLVESGGGLVEPGRSLRLSCTGSGFTFGDYVLSWVRQAPGKGLEWVGFIRSKAYGETTEHAASVKGRFTISRDDSKSIAYLQMSSLKTEDTAVYFCARGLRPTRKADYWGQGTLVTVSS

SEQ ID NO: 443 - protein, 12 aa, Artificial Sequence
  Synthetic
ARGLRPTRKADY

SEQ ID NO: 444 - protein, 111 aa, Artificial Sequence
  Synthetic
QSVLTQPASVSGSPGQSITISCTGTRSDVGGYNSVSWYRQHPNKAPKLMIYDVSNRPSGVSNRFSGSKSGNTASLTISGLQAEDEADYYCTSYTSSTTLDVFGTGTKVTVL

SEQ ID NO: 445 - protein, 11 aa, Artificial Sequence
  Synthetic
TSYTSSTTLDV

SEQ ID NO: 446 - protein, 121 aa, Artificial Sequence; identical to SEQ ID NO: 402
  Synthetic

SEQ ID NO: 447 - protein, 12 aa, Artificial Sequence
  Synthetic
ARGLRPTRKADY

SEQ ID NO: 448 - protein, 111 aa, Artificial Sequence; identical to SEQ ID NO: 404
  Synthetic

SEQ ID NO: 449 - protein, 11 aa, Artificial Sequence
  Synthetic
TSYTSSTTLDV

SEQ ID NO: 450 - protein, 121 aa, Artificial Sequence; identical to SEQ ID NO: 402
  Synthetic

SEQ ID NO: 451 - protein, 12 aa, Artificial Sequence
  Synthetic
ARGLRPTRKADY

SEQ ID NO: 452 - protein, 111 aa, Artificial Sequence; identical to SEQ ID NO: 404
  Synthetic

SEQ ID NO: 453 - protein, 11 aa, Artificial Sequence
  Synthetic
TSYTSSTTLDV

SEQ ID NO: 454 - protein, 121 aa, Artificial Sequence
  Synthetic
QVQLQESGPGLVKPSQTLSLTCTVSGGSISSGDYYWSWIRQPPGKGLEWIGYIYYSGSTYYNPSLKSRITISVDTSKNQFSLKLSSVTAADTAVYYCARVWGLLLFRFDYWGQGTLVTVSS

SEQ ID NO: 455 - protein, 13 aa, Artificial Sequence
  Synthetic
ARVWGLLLFRFDY

SEQ ID NO: 456 - protein, 110 aa, Artificial Sequence
  Synthetic
SYVLTQPPSVSVAPGQTARITCGGNNIGSKNVHWYQQKPGQAPVLVVYDDSDRPSGIPERFSGSNSGNTATLTISRVEAGDEADYYCQVWDSTSDHPRVVFGGGTKLTVL

SEQ ID NO: 457 - protein, 13 aa, Artificial Sequence
  Synthetic
QVWDSTSDHPRVV

SEQ ID NO: 458 - protein, 130 aa, Artificial Sequence; identical to SEQ ID NO: 394
  Synthetic

SEQ ID NO: 459 - protein, 24 aa, Artificial Sequence
  Synthetic
ARAAGVRSVVAAASTYYYYYGMDV

SEQ ID NO: 460 - protein, 109 aa, Artificial Sequence
  Synthetic
QSVLTQPASVSGSPGQSITISCTGTSSDVGGYDYVSWYQQHPGKAPKLMIYDVSNRPSGVSNRFSGSKSANTASLTISGLQAEDEADYYCSSYTSSGWVFGGGTKLTVL

SEQ ID NO: 461 - protein, 9 aa, Artificial Sequence
  Synthetic
SSYTSSGWV

SEQ ID NO: 462 - protein, 130 aa, Artificial Sequence
  Synthetic
QVQLQESGPGLVKPSETLSLTCTVSRGSISSYYWSWIRQPPGRGLEWIGYIYYSGGTNYNPSLKSRVTISVDTSKNQFSLKLSSVTAADTAVYYCARAAGVRSVVAAASTYYYYYGMDVWGQGTTVTVSS

SEQ ID NO: 463 - protein, 24 aa, Artificial Sequence
  Synthetic
ARAAGVRSVVAAASTYYYYYGMDV

SEQ ID NO: 464 - protein, 109 aa, Artificial Sequence
  Synthetic
QSVLTQPASVSGSPGQSITISCTGISSDVGGYNYVSWYQQHPGKAPKLMIYDVSNRPSGVSNRFSGSKSGNTASLTISGLQAEDEADYYCSSYTSSGWVFGGGTKLTVL

SEQ ID NO: 465 - protein, 9 aa, Artificial Sequence
  Synthetic
SSYTSSGWV

SEQ ID NO: 466 - protein, 130 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTALYYCARAAGVRSVVAAASTYYYYYGMDVWGQGTTVTVSS

SEQ ID NO: 467 - protein, 24 aa, Artificial Sequence
  Synthetic
ARAAGVRSVVAAASTYYYYYGMDV

SEQ ID NO: 468 - protein, 109 aa, Artificial Sequence; identical to SEQ ID NO: 364
  Synthetic

SEQ ID NO: 469 - protein, 9 aa, Artificial Sequence
  Synthetic
SSYTSSGWV

SEQ ID NO: 470 - protein, 121 aa, Artificial Sequence; identical to SEQ ID NO: 402
  Synthetic

SEQ ID NO: 471 - protein, 12 aa, Artificial Sequence
  Synthetic
ARGLRPTRKADY

SEQ ID NO: 472 - protein, 111 aa, Artificial Sequence; identical to SEQ ID NO: 404
  Synthetic

SEQ ID NO: 473 - protein, 11 aa, Artificial Sequence
  Synthetic
TSYTSSTTLDV

SEQ ID NO: 474 - protein, 121 aa, Artificial Sequence; identical to SEQ ID NO: 402
  Synthetic

SEQ ID NO: 475 - protein, 12 aa, Artificial Sequence
  Synthetic
ARGLRPTRKADY

SEQ ID NO: 476 - protein, 111 aa, Artificial Sequence; identical to SEQ ID NO: 404
  Synthetic

SEQ ID NO: 477 - protein, 11 aa, Artificial Sequence
  Synthetic
TSYTSSTTLDV

SEQ ID NO: 478 - protein, 130 aa, Artificial Sequence; identical to SEQ ID NO: 394
  Synthetic

SEQ ID NO: 479 - protein, 24 aa, Artificial Sequence
  Synthetic
ARAAGVRSVVAAASTYYYYYGMDV

SEQ ID NO: 480 - protein, 109 aa, Artificial Sequence; identical to SEQ ID NO: 364
  Synthetic

SEQ ID NO: 481 - protein, 9 aa, Artificial Sequence
  Synthetic
SSYTSSGWV

SEQ ID NO: 482 - protein, 120 aa, Artificial Sequence
  Synthetic
QLQLQESGPGLVKPSETLSLTCTVSGGSISSSSYFWGWIRQPPGKGLESIGSIYYSGSTYYNPSLKSRVTISVDTSKNQFSLKLSSVTAADTAVYYCARSRWLRGSFDYWGQGTLVTVSS

SEQ ID NO: 483 - protein, 12 aa, Artificial Sequence
  Synthetic
ARSRWLRGSFDY

SEQ ID NO: 484 - protein, 111 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVL

SEQ ID NO: 485 - protein, 10 aa, Artificial Sequence
  Synthetic
QSYDSSNHWV

SEQ ID NO: 486 - protein, 130 aa, Artificial Sequence; identical to SEQ ID NO: 394
  Synthetic

SEQ ID NO: 487 - protein, 24 aa, Artificial Sequence
  Synthetic
ARAAGVRSVVAAASTYYYYYGMDV

SEQ ID NO: 488 - protein, 109 aa, Artificial Sequence; identical to SEQ ID NO: 460
  Synthetic

SEQ ID NO: 489 - protein, 9 aa, Artificial Sequence
  Synthetic
SSYTSSGWV

SEQ ID NO: 490 - protein, 120 aa, Artificial Sequence; identical to SEQ ID NO: 15
  Synthetic

SEQ ID NO: 491 - protein, 13 aa, Artificial Sequence
  Synthetic
AREDVGGTGYFDY

SEQ ID NO: 492 - protein, 109 aa, Artificial Sequence
  Synthetic
SYVLTQPPSVSVAPGQTARITCGANNIGSKSVHWYQQKPGQAPVLVVYDDSDRPSGIPERFSGSNSGNTATLTISRVEAGDEADYYCQVWDGSSDHFYVFGTGTTVTVL

SEQ ID NO: 493 - protein, 12 aa, Artificial Sequence
  Synthetic
QVWDGSSDHFYV

SEQ ID NO: 494 - protein, 130 aa, Artificial Sequence; identical to SEQ ID NO: 462
  Synthetic

SEQ ID NO: 495 - protein, 24 aa, Artificial Sequence
  Synthetic
ARAAGVRSVVAAASTYYYYYGMDV

SEQ ID NO: 496 - protein, 109 aa, Artificial Sequence; identical to SEQ ID NO: 396
  Synthetic

SEQ ID NO: 497 - protein, 9 aa, Artificial Sequence
  Synthetic
SSYTSSGWV

SEQ ID NO: 498 - protein, 117 aa, Artificial Sequence; identical to SEQ ID NO: 11
  Synthetic

SEQ ID NO: 499 - protein, 10 aa, Artificial Sequence
  Synthetic
ARNCAWGSCD

SEQ ID NO: 500 - protein, 110 aa, Artificial Sequence
  Synthetic
QSVLTQEPAFSVSPGGTVTLTCGLSSGSVSTSHHPCWYQQTPGQAPRTLIYDTDARSSGVPDRFSGSILGDKAALTITGAQADDESDYYCALYMGSGSWVFGGGTKLTVL

SEQ ID NO: 501 - protein, 10 aa, Artificial Sequence
  Synthetic
ALYMGSGSWV

SEQ ID NO: 502 - protein, 130 aa, Artificial Sequence; identical to SEQ ID NO: 394
  Synthetic

SEQ ID NO: 503 - protein, 24 aa, Artificial Sequence
  Synthetic
ARAAGVRSVVAAASTYYYYYGMDV

SEQ ID NO: 504 - protein, 109 aa, Artificial Sequence
  Synthetic
QSALTQPASVSGSPGQSITISCTGTSSDIGGYNYVSWYQQHPGKAPKLMIYDVSNRPSGVSNRFSGSKSGNTASLTISGLQAEDEADYYCSSYTSSGWVFGGGTKLTVL

SEQ ID NO: 505 - protein, 9 aa, Artificial Sequence
  Synthetic
SSYTSSGWV

SEQ ID NO: 506 - protein, 119 aa, Artificial Sequence
  Synthetic
EVQLVESGGGLMQPGGSLRLSCAASGFTVSSNYMSWVRQAPGKGLEWVSVIYSGGSTYYADSVKGRFTISRDNSKNTLYLQMNSLRAEDTAVYYCARDLSGDYVYLDYWGQGTLVTVSS

SEQ ID NO: 507 - protein, 13 aa, Artificial Sequence
  Synthetic
ARDLSGDYVYLDY

SEQ ID NO: 508 - protein, 110 aa, Artificial Sequence
  Synthetic
QSVLTQPPSASGTPGQRVTISCSGSSSNIGSTYVYWYQQLPGTAPKLLIYRNNQRPSGVPDRFSGSKSGTSASLAISGLRSEDEADYCCAAWDDSLSGPVFGGGTKLTVL

SEQ ID NO: 509 - protein, 11 aa, Artificial Sequence
  Synthetic
AAWDDSLSGPV

SEQ ID NO: 510 - protein, 117 aa, Artificial Sequence; identical to SEQ ID NO: 11
  Synthetic

SEQ ID NO: 511 - protein, 10 aa, Artificial Sequence
  Synthetic
ARNCAWGSCD

SEQ ID NO: 512 - protein, 110 aa, Artificial Sequence; identical to SEQ ID NO: 500
  Synthetic

SEQ ID NO: 513 - protein, 10 aa, Artificial Sequence
  Synthetic
ALYMGSGSWV

SEQ ID NO: 514 - protein, 118 aa, Artificial Sequence; identical to SEQ ID NO: 21
  Synthetic

SEQ ID NO: 515 - protein, 12 aa, Artificial Sequence
  Synthetic
ARDLEAAGGMDV

SEQ ID NO: 516 - protein, 106 aa, Artificial Sequence
  Synthetic
DIQLTQSPSFLSASVGDRVTITCRASQGISSYLAWYQQKPGKAPKLLIYAASTLQSVPSRFSGSGSGTEFTLTISSLQPEDFATYYCQQLNGYPLTFGGGTKVEIK

SEQ ID NO: 517 - protein, 9 aa, Artificial Sequence
  Synthetic
QQLNGYPLT

SEQ ID NO: 518 - protein, 116 aa, Artificial Sequence
  Synthetic
EVQLVESGGALIQPGGSLRLSCAASGFTVSSNYMSWVRQAPGKGLEWVSIIYSGGSTFYADSVKGRFTISRDNSKNTLYLQMNSLRAEDTAVYYCARDVAGYLDIWGQGTMVTVSS

SEQ ID NO: 519 - protein, 10 aa, Artificial Sequence
  Synthetic
ARDVAGYLDI

SEQ ID NO: 520 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYHALTFGGGTKVEIK

SEQ ID NO: 521 - protein, 10 aa, Artificial Sequence
  Synthetic
QQLNSYHALT

SEQ ID NO: 522 - protein, 117 aa, Artificial Sequence
  Synthetic
EVQLVESGGGLIQPGGSLRLSCAASGLTVSSNYMSWVRQAPGKGLEWVSLIYSGGSTFYADSVKGRFTISRDNSKNTLYFQMNSLRAEDTAVYYCARGYGEKYFDIWGQGTMVTVSS

SEQ ID NO: 523 - protein, 11 aa, Artificial Sequence
  Synthetic
ARGYGEKYFDI

SEQ ID NO: 524 - protein, 103 aa, Artificial Sequence
  Synthetic
DIQMTQSPSTLSASVGDRVTITCRASQSINNWLAWYQQKPGKAPNLLIYKASSLESGVPSRFSGSGSGTEFTLTISSLQPDDFATYYCQHYRTFGQGTKVEIK

SEQ ID NO: 525 - protein, 5 aa, Artificial Sequence
  Synthetic
QHYRT

SEQ ID NO: 526 - protein, 133 aa, Artificial Sequence
  Synthetic
QVQLVQSGAEVKKPGSSVKVSCKASGGTFSSYAISWVRQAPGQGLEWMGGIIPIFRTANYAQKFQGRVTITADESTRTVYMELSSLRSEDTAVYYCARGGEEGIAVAAKGWTEQNYENWFDPWGQGTLVTVSS

SEQ ID NO: 527 - protein, 26 aa, Artificial Sequence
  Synthetic
ARGGEEGIAVAAKGWTEQNYENWFDP

SEQ ID NO: 528 - protein, 113 aa, Artificial Sequence
  Synthetic
DIVMTQSPDSLAVSLGERATINCKSSQSVLYSSNNKNYLAWYQQKPGQPPKLLIYWASTRESGVPDRFSGSGSGTDFTLTISSLQAEDVAVYFCQQYHSTPLTFGGGTKVEIK

SEQ ID NO: 529 - protein, 9 aa, Artificial Sequence
  Synthetic
QQYHSTPLT

SEQ ID NO: 530 - protein, 121 aa, Artificial Sequence
  Synthetic
EVQLVESGGGLIQPGGSLRLSCAASGFTVSSNYMNWVRQAPGKGLEWVSIIYSGGSTYYADSVKGRFTISRDNSKNTLYLQMNSLRADDTAVYYCARHHPGYCSGGRCYAWGQGTLVTVSS

SEQ ID NO: 531 - protein, 15 aa, Artificial Sequence
  Synthetic
ARHHPGYCSGGRCYA

SEQ ID NO: 532 - protein, 107 aa, Artificial Sequence
  Synthetic
DIQMTQSPSSLSASVGDRVTITCQASQDIRKYLNWYQQKPGKAPKLLIYDASNLETGVPSRFSGSGSGTDFTFTISSLQPEDIATYYCQQFDNLPITFGQGTRLEIK

SEQ ID NO: 533 - protein, 9 aa, Artificial Sequence
  Synthetic
QQFDNLPIT

SEQ ID NO: 534 - protein, 128 aa, Artificial Sequence; identical to SEQ ID NO: 37
  Synthetic

SEQ ID NO: 535 - protein, 21 aa, Artificial Sequence
  Synthetic
AKDSHYYYYDSSGYYGSIPDY

SEQ ID NO: 536 - protein, 113 aa, Artificial Sequence
  Synthetic
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPHSAFGPGTKVDIK

SEQ ID NO: 537 - protein, 10 aa, Artificial Sequence
  Synthetic
MQSIQLPHSA

SEQ ID NO: 538 - protein, 124 aa, Artificial Sequence
  Synthetic
QVQLVESGGGVVQPGRSLRLSCAASGFTFSSDGMHWVRQAPGKGLEWVALIWYDGTNKYYADSVKGRFTISRDNSKNTLYLQMNSLRAEDTAVYYCAREWDLGSGADLGYFQHWGQGTLVTVSS

SEQ ID NO: 539 - protein, 17 aa, Artificial Sequence
  Synthetic
AREWDLGSGADLGYFQH

SEQ ID NO: 540 - protein, 108 aa, Artificial Sequence [sequence omitted]

SEQ ID NO: 541 - protein, 10 aa, Artificial Sequence
  Synthetic
QQRSNWPPLT

SEQ ID NO: 542 - protein, 117 aa, Artificial Sequence
  Synthetic
EVQLVESGGGLVQPGGSLRLSCAASGFIVSSNYMSWVRQAPGKGLEWVSVIYSGGSTFYADSVKGRFTISRDNSKNTLYLQMNSLRAEDTAVYYCARDLGGLRFDYWGQGTLVTVSS

SEQ ID NO: 543 - protein, 11 aa, Artificial Sequence
  Synthetic
ARDLGGLRFDY

SEQ ID NO: 544 - protein, 108 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPSYTFGQGTKLEIK

SEQ ID NO: 545 - protein, 10 aa, Artificial Sequence
  Synthetic
QQYDNLPSYT

SEQ ID NO: 546 - protein, 125 aa, Artificial Sequence
  Synthetic
QVQLVQSGAEVKKPGASVMVSCKASGYTFTSYYMHWVRQAPGQGLQWMGIINPSGGSTSYAQKFQGRVTMTRDTSTNTVYMELSSLRSEDTAVYYCASGYCSSNSCHAGDAFDIWGQGTMVTVSS

SEQ ID NO: 547 - protein, 18 aa, Artificial Sequence
  Synthetic
ASGYCSSNSCHAGDAFDI

SEQ ID NO: 548 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGGGTKVEIK

SEQ ID NO: 549 - protein, 9 aa, Artificial Sequence
  Synthetic
QQSYSTPPT

SEQ ID NO: 550 - protein, 133 aa, Artificial Sequence
  Synthetic
QVQLVQSGAEVKKPGSSVKVSCKASGGTFSSYAISWVRQAPGQGLEWMGGIIPIFRTAKYAQKFQGRVTITADESTRTVYMELSSLRSEDTAVYYCARGGEEGIAVADKGWTEQNYENWFDPWGQGTLVTVSS

SEQ ID NO: 551 - protein, 26 aa, Artificial Sequence
  Synthetic
ARGGEEGIAVADKGWTEQNYENWFDP

SEQ ID NO: 552 - protein, 113 aa, Artificial Sequence
  Synthetic
DIVMTQSPDSLAVSLGERATINCKSSQSVLYSSKNKNYLAWYQQKPGQPPKLIIYWASTRESGVPDRFSGSGSGTDFTLTISSLQAEDVAVYFCQQYHSTPLTFGGGTKVEIK

SEQ ID NO: 553 - protein, 9 aa, Artificial Sequence
  Synthetic
QQYHSTPLT

SEQ ID NO: 554 - protein, 116 aa, Artificial Sequence
  Synthetic
EVQLVESGGGLIQPGGSLRLSCAASGFIVSSNYMNWVRQAPGKGLEWVSVIYSGGSTYYADSVKGRFTISRDNSKNTLYLQMNSLRAEDTAVYYCAREVYGYFDYWGQGTLVTVSS

SEQ ID NO: 555 - protein, 10 aa, Artificial Sequence
  Synthetic
AREVYGYFDY

SEQ ID NO: 556 - protein, 108 aa, Artificial Sequence
  Synthetic
DIQMTQSPSSLSASVGDRVTITCRASQGISNYLAWYQQKPGKGPKLLIYGASTLQSGVPSRFSGSGSGTEFTLTISSLQPEDVATYYCQKYNSAPPYTFGQGTKLEIK

SEQ ID NO: 557 - protein, 10 aa, Artificial Sequence
  Synthetic
QKYNSAPPYT

SEQ ID NO: 558 - protein, 125 aa, Artificial Sequence; identical to SEQ ID NO: 7
  Synthetic

SEQ ID NO: 559 - protein, 18 aa, Artificial Sequence
  Synthetic
ASGYCSSGSCHAGDAFDI

SEQ ID NO: 560 - protein, 107 aa, Artificial Sequence; identical to SEQ ID NO: 8
  Synthetic

SEQ ID NO: 561 - protein, 9 aa, Artificial Sequence
  Synthetic
QQSYSTPPT

SEQ ID NO: 562 - protein, 120 aa, Artificial Sequence; identical to SEQ ID NO: 27
  Synthetic

SEQ ID NO: 563 - protein, 14 aa, Artificial Sequence
  Synthetic
ARDHVAAMVQGQGV

SEQ ID NO: 564 - protein, 107 aa, Artificial Sequence; identical to SEQ ID NO: 28
  Synthetic

SEQ ID NO: 565 - protein, 9 aa, Artificial Sequence
  Synthetic
QQYDNLPLT

SEQ ID NO: 566 - protein, 129 aa, Artificial Sequence
  Synthetic
EVQLVQSGAEVKKPGESLKISCQGSGYRFTSYWIGWVRQMPGKGLEWMGIIYPGDSDTRYSPSFQGQVTISADKSINTAYLQWSSLKASDTAIYYCARHERAYNSSRVGYYYYYGVDVWGQGTAVSVSS

SEQ ID NO: 567 - protein, 22 aa, Artificial Sequence
  Synthetic
ARHERAYNSSRVGYYYYYGVDV

SEQ ID NO: 568 - protein, 108 aa, Artificial Sequence
  Synthetic
EIVLTQSPATLSLSPGERATLSCRASQSVSSHLAWFQQKPGQAPRLLIYDASVRATGIPARFSGSGSGTDFTLTISSLESEDFAVYYCQQRSSWPSYTFGQGTKVEIK

SEQ ID NO: 569 - protein, 10 aa, Artificial Sequence
  Synthetic
QQRSSWPSYT

SEQ ID NO: 570 - protein, 118 aa, Artificial Sequence
  Synthetic
EVQLVESGGGLIQPGGSLRLSCAASGVTVSSNYMSWVRQAPGKGLEWVSVIYSGGSTFYADSVKGRFTISRDNSKNTLYLQMNSLRAEDTAVYYCARDLGIVGATDYWGQGTLVTVSS

SEQ ID NO: 571 - protein, 12 aa, Artificial Sequence
  Synthetic
ARDLGIVGATDY

SEQ ID NO: 572 - protein, 107 aa, Artificial Sequence
  Synthetic
EIVMTQSPLSVSPGERATLSCRASQSVSSNLAWYQQKPGQAPRLLIYGASTRATGIPARFSGSGSGTEFTLTISSLQSEDFAVYYCQQYNNWPPGYTFGQGTKLEIK

SEQ ID NO: 573 - protein, 11 aa, Artificial Sequence
  Synthetic
QQYNNWPPGYT

SEQ ID NO: 574 - protein, 124 aa, Artificial Sequence; identical to SEQ ID NO: 35
  Synthetic

SEQ ID NO: 575 - protein, 17 aa, Artificial Sequence
  Synthetic
AKGSYYDILTGYYGLDY

SEQ ID NO: 576 - protein, 112 aa, Artificial Sequence; identical to SEQ ID NO: 36
  Synthetic

SEQ ID NO: 577 - protein, 9 aa, Artificial Sequence
  Synthetic
MQALQTPYT

SEQ ID NO: 578 - protein, 124 aa, Artificial Sequence; identical to SEQ ID NO: 39
  Synthetic

SEQ ID NO: 579 - protein, 17 aa, Artificial Sequence
  Synthetic
ARVGARITGTSTYYFDY

SEQ ID NO: 580 - protein, 109 aa, Artificial Sequence; identical to SEQ ID NO: 40
  Synthetic

SEQ ID NO: 581 - protein, 11 aa, Artificial Sequence
  Synthetic
QQRSTWPRGFT

SEQ ID NO: 582 - protein, 117 aa, Artificial Sequence; identical to SEQ ID NO: 31
  Synthetic

SEQ ID NO: 583 - protein, 11 aa, Artificial Sequence
  Synthetic
ARDRGGALHDY

SEQ ID NO: 584 - protein, 110 aa, Artificial Sequence; identical to SEQ ID NO: 32
  Synthetic

SEQ ID NO: 585 - protein, 12 aa, Artificial Sequence
  Synthetic
QQLNSYPEGIFT

SEQ ID NO: 586 - protein, 115 aa, Artificial Sequence
  Synthetic
EVQLVESGGGFVQPGGSLRLSCAASGITVSSNYMSWVRQAPGKGLEWVSVIFSGGSTFYADSVKGRFTISRDNSKNILYLQMNSLRAEDTAVYYCAREVYAFDIWGQGTMVTVSS

SEQ ID NO: 587 - protein, 9 aa, Artificial Sequence
  Synthetic
AREVYAFDI

SEQ ID NO: 588 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLSSYPPAFGGGTKVEIK

SEQ ID NO: 589 - protein, 9 aa, Artificial Sequence
  Synthetic
QQLSSYPPA

SEQ ID NO: 590 - protein, 115 aa, Artificial Sequence
  Synthetic
EVQLVESGGGLIQPGGSLRLSCAASGITVSSNYMSWVRQAPGKGLEWVSVIYPGGSTYYADSVKGRFTISRDNSKNTLYLQMNSLRAEDTAVYYCARDLGYMDVWGKGTTVTVSS

SEQ ID NO: 591 - protein, 9 aa, Artificial Sequence
  Synthetic
ARDLGYMDV

SEQ ID NO: 592 - protein, 108 aa, Artificial Sequence
  Synthetic
DIQMTQSPSSLSASVGDRVTITCRASQGISNYLAWYQQKPGKVLKLLIYDATTLQSGVPSRFSGSGSGTDFTLTISSLQPEDVATYYCQKYNSAPPWTFGQGTKVEIK

SEQ ID NO: 593 - protein, 10 aa, Artificial Sequence
  Synthetic
QKYNSAPPWT

SEQ ID NO: 594 - protein, 133 aa, Artificial Sequence
  Synthetic
QVQLVQSGAEVKKPGSSVKVSCKASGGTFSSYGINWVRQAPGQGLEWMGGIIPIFRTANYAQKFQGRVTITADESTRTVYMELSSLRSEDTAVYYCARGGEEGIAVAGKGWTEQNYENWFDPWGQGTLVTVSS

SEQ ID NO: 595 - protein, 26 aa, Artificial Sequence
  Synthetic
ARGGEEGIAVAGKGWTEQNYENWFDP

SEQ ID NO: 596 - protein, 113 aa, Artificial Sequence; identical to SEQ ID NO: 6
  Synthetic

SEQ ID NO: 597 - protein, 9 aa, Artificial Sequence
  Synthetic
QQYHSTPLT

SEQ ID NO: 598 - protein, 117 aa, Artificial Sequence; identical to SEQ ID NO: 23
  Synthetic

SEQ ID NO: 599 - protein, 11 aa, Artificial Sequence
  Synthetic
ARDLDYYGMDV

SEQ ID NO: 600 - protein, 108 aa, Artificial Sequence; identical to SEQ ID NO: 24
  Synthetic

SEQ ID NO: 601 - protein, 10 aa, Artificial Sequence
  Synthetic
QLLNSYPRLT

SEQ ID NO: 602 - protein, 133 aa, Artificial Sequence; identical to SEQ ID NO: 5
  Synthetic

SEQ ID NO: 603 - protein, 26 aa, Artificial Sequence
  Synthetic
ARGGEEGIAVAAKGWTEQNYENWFDP

SEQ ID NO: 604 - protein, 113 aa, Artificial Sequence; identical to SEQ ID NO: 6
  Synthetic

SEQ ID NO: 605 - protein, 9 aa, Artificial Sequence
  Synthetic
QQYHSTPLT

SEQ ID NO: 606 - protein, 117 aa, Artificial Sequence
  Synthetic
EVQLVESGGGLIQPGGSLRLSCAASGILVSSNYMNWVRQAPGMGLEWVSVIYSGGSTFYADSVKGRFTISRDNSKNTLYLQMNSLRAEDTAMYYCARDLGVSGMDVWGQGTAVTVSS

SEQ ID NO: 607 - protein, 11 aa, Artificial Sequence
  Synthetic
ARDLGVSGMDV

SEQ ID NO: 608 - protein, 106 aa, Artificial Sequence; identical to SEQ ID NO: 30
  Synthetic

SEQ ID NO: 609 - protein, 8 aa, Artificial Sequence
  Synthetic
QHLNSYSL

SEQ ID NO: 610 - protein, 125 aa, Artificial Sequence
  Synthetic
QVQLVQSGAEVKKPGASVKVSCKASGYTFTSYYMHWVRQAPGQGLEWMGIINPSGTSTSYAQKFQGRVTMTRDTSTSTVYMELSSLRSEDTAVYYCASGYCSSTSCHAGDAFDIWGQGTMVTVSS

SEQ ID NO: 611 - protein, 18 aa, Artificial Sequence
  Synthetic
ASGYCSSTSCHAGDAFDI

SEQ ID NO: 612 - protein, 107 aa, Artificial Sequence
  Synthetic
DIQMTQSPSSLSASVGDRVTITCRASQSISSYLIWYQQKPGKAPNLLIYAASSLQSGVPSRFSGSGSGTDFTLTISSLQPADFATYYCQQSYSTPPTFGGGTKVEIK

SEQ ID NO: 613 - protein, 9 aa, Artificial Sequence
  Synthetic
QQSYSTPPT

SEQ ID NO: 614 - protein, 122 aa, Artificial Sequence; identical to SEQ ID NO: 33
  Synthetic

SEQ ID NO: 615 - protein, 15 aa, Artificial Sequence
  Synthetic
AKDLNALQHVETFDP

SEQ ID NO: 616 - protein, 108 aa, Artificial Sequence; identical to SEQ ID NO: 34
  Synthetic

SEQ ID NO: 617 - protein, 10 aa, Artificial Sequence
  Synthetic
QQSYSTLPYT

SEQ ID NO: 618 - protein, 117 aa, Artificial Sequence; identical to SEQ ID NO: 25
  Synthetic

SEQ ID NO: 619 - protein, 11 aa, Artificial Sequence
  Synthetic
ARDWGEYYFDY

SEQ ID NO: 620 - protein, 107 aa, Artificial Sequence
  Synthetic
EIVLTQSPSLSLSPGERATLSCRASQIVSSSYLAWYQQKPGQAPRLLIYGASSRATGIPDRFSGSGSGTDFTLTISGLEPEDFAVYYCQQYDSSPRTFGQGTKVEIK

SEQ ID NO: 621 - protein, 9 aa, Artificial Sequence
  Synthetic
QQYDSSPRT

SEQ ID NO: 622 - protein, 120 aa, Artificial Sequence
  Synthetic
QVQLVESGGGVVQPGRSLRLSCAASGFTFSSYAMHWVRQAPGKGLEWVALISYDGSNKHYADSVKGRFTISRDNSKNTLYLQMNSLRAEDTAVYYCARAGTTNSDYFDYWGQGTLVTVSS

SEQ ID NO: 623 - protein, 13 aa, Artificial Sequence
  Synthetic
ARAGTTNSDYFDY

SEQ ID NO: 624 - protein, 112 aa, Artificial Sequence
  Synthetic
DVVMTQSPLSLPVTLGQPASISCRSSQSLVYSDGNTYLNWFQQRPGQSPRRLIYQVSNRDSGVPDRFSGSGSGTDFTLQISTVEAEDVGVYYCIQGSLWPRAFGQGTKLEVK

SEQ ID NO: 625 - protein, 9 aa, Artificial Sequence
  Synthetic
IQGSLWPRA

SEQ ID NO: 626 - protein, 123 aa, Artificial Sequence
  Synthetic
QVQLQESGPGLVKPSQTLSLTCTVSGGSISSSDYYWSWIRQPPGKGLEWIGYIYYSGSTYYNPSLKSRVTISVDRSKNQFSLKLSSVTAADTAVYYCARVNGIGYYDSSGYDYWGQGTLVTVS

SEQ ID NO: 627 - protein, 16 aa, Artificial Sequence
  Synthetic
ARVNGIGYYDSSGYDY

SEQ ID NO: 628 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPDTFGQGTKLEIK

SEQ ID NO: 629 - protein, 9 aa, Artificial Sequence
  Synthetic
QQLNSYPDT

SEQ ID NO: 630 - protein, 125 aa, Artificial Sequence; identical to SEQ ID NO: 71
  Synthetic

SEQ ID NO: 631 - protein, 17 aa, Artificial Sequence
  Synthetic
ARRGRVYGGNSGNAFDI

SEQ ID NO: 632 - protein, 108 aa, Artificial Sequence
  Synthetic
QSVLTQPASVSGSPGQSITISCTGTSSDVGSYDLVSWYQQHPGKSPKLMIYEVIKRPSGVSNRFSGSKSGNTASLTISGLQAEDEADYYCCSYAGSWVFGGGTKLTVL

SEQ ID NO: 633 - protein, 8 aa, Artificial Sequence
  Synthetic
CSYAGSWV

SEQ ID NO: 634 - protein, 130 aa, Artificial Sequence; identical to SEQ ID NO: 394
  Synthetic

SEQ ID NO: 635 - protein, 24 aa, Artificial Sequence
  Synthetic
ARAAGVRSVVAAASTYYYYYGMDV

SEQ ID NO: 636 - protein, 109 aa, Artificial Sequence; identical to SEQ ID NO: 396
  Synthetic

SEQ ID NO: 637 - protein, 9 aa, Artificial Sequence
  Synthetic
SSYTSSGWV

SEQ ID NO: 638 - protein, 125 aa, Artificial Sequence; identical to SEQ ID NO: 55
  Synthetic

SEQ ID NO: 639 - protein, 18 aa, Artificial Sequence
  Synthetic
AKDVMVWSGSYLPEYFQH

SEQ ID NO: 640 - protein, 105 aa, Artificial Sequence
  Synthetic
SYVLTQPPSVSVSPGQTASITCSGHKLGDKYACWYQQKPGQSPVLVIYQDNKRPSGIPERFSGSNSGNTATLTISGTQAMDEADYYCQSWDSSVVFGGGTKLTVL

SEQ ID NO: 641 - protein, 8 aa, Artificial Sequence
  Synthetic
QSWDSSVV

SEQ ID NO: 642 - protein, 124 aa, Artificial Sequence; identical to SEQ ID NO: 45
  Synthetic

SEQ ID NO: 643 - protein, 17 aa, Artificial Sequence
  Synthetic
AREFAVVPVASTWWFDP

SEQ ID NO: 644 - protein, 111 aa, Artificial Sequence; identical to SEQ ID NO: 46
  Synthetic

SEQ ID NO: 645 - protein, 11 aa, Artificial Sequence
  Synthetic
QSYDSSLSGSV

SEQ ID NO: 646 - protein, 127 aa, Artificial Sequence
  Synthetic
QVQLVQSGAEVKKPGASVKVSCKASGYPFTGYYMHWVRQAPGQGLEWMGWINPNSGGTNYSQKFQGRVTMTRDTSFSTAYMELSRLKSDDTAVYYCARTAGYCSGGSCYTRHPFDYWGQGTLVTVSS

SEQ ID NO: 647 - protein, 20 aa, Artificial Sequence
  Synthetic
ARTAGYCSGGSCYTRHPFDY

SEQ ID NO: 648 - protein, 108 aa, Artificial Sequence
  Synthetic
SYVLTQPPSVSVAPGQTARITCGGNNIGSKSVHWYQQKPGQAPVLVVNDDSDRPSGIPERFSGSNSGNTATLTISRVEAGDEADYYCQVWDFSSDLMVFGGGTKLTVL

SEQ ID NO: 649 - protein, 11 aa, Artificial Sequence
  Synthetic
QVWDFSSDLMV

SEQ ID NO: 650 - protein, 125 aa, Artificial Sequence
  Synthetic
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGGAATGPGLSWWFDPWGQGTLVTVSS

SEQ ID NO: 651 - protein, 17 aa, Artificial Sequence
  Synthetic
ARGGAATGPGLSWWFDP

SEQ ID NO: 652 - protein, 107 aa, Artificial Sequence
  Synthetic
SYVLTQPPSVSVAPGQTARITCGGNNIGSKNVHWYQQKPGQAPVLVVYDDSDRPSGIPERFSGSNSGNTATLTISRVEAGDEADYYCQVWDSSSDVVFGGGTKLTVL

SEQ ID NO: 653 - protein, 10 aa, Artificial Sequence
  Synthetic
QVWDSSSDVV

SEQ ID NO: 654 - protein, 120 aa, Artificial Sequence
  Synthetic
QVQLVQSGAEVKKPGASVKVSCKASGYTFTSYDINWVRQATGQGLEWMGWMNPNSGNTGYAQKFQGRVTMTRNTSISTAYMELSSLRSEDMAVYYCARVSPAGTWYFDLWGRGTLVTVSS

SEQ ID NO: 655 - protein, 13 aa, Artificial Sequence
  Synthetic
ARVSPAGTWYFDL

SEQ ID NO: 656 - protein, 110 aa, Artificial Sequence
  Synthetic
SYVLTQPPSVSVAPRQTARITCGGNNIGSKNVHWYQQKPGQAPVLVVYDDMDRPSGIPERFSGSNSGNTATLTISRVEAGDEADYYCQVWDSTTDHPKVVFGGGTKLTVL

SEQ ID NO: 657 - protein, 13 aa, Artificial Sequence
  Synthetic
QVWDSTTDHPKVV

SEQ ID NO: 658 - protein, 130 aa, Artificial Sequence; identical to SEQ ID NO: 394
  Synthetic

SEQ ID NO: 659 - protein, 24 aa, Artificial Sequence
  Synthetic
ARAAGVRSVVAAASTYYYYYGMDV

SEQ ID NO: 660 - protein, 109 aa, Artificial Sequence
  Synthetic
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSGWVFGGGTKVTVL

SEQ ID NO: 661 - protein, 9 aa, Artificial Sequence
  Synthetic
SSYTSSGWV

SEQ ID NO: 662 - protein, 125 aa, Artificial Sequence
  Synthetic
QVQLVESGGGVVQPGRSLRLSCAASGFTFSSYGMHWVRQAPGKGLEWVAVISNDGSKKKNADSVKGRFTISRDNSKNTLYLQMNSLRADDTAVYYCARDGPLKQQLVIPNWFDPWGQGTLVTVSS

SEQ ID NO: 663 - protein, 18 aa, Artificial Sequence
  Synthetic
ARDGPLKQQLVIPNWFDP

SEQ ID NO: 664 - protein, 107 aa, Artificial Sequence
  Synthetic
SYVLTQPPSVSVAPGQTARITCGENNIGSKNVHWYQQKPGQAPVLVVYDDSDRPSGIPERFSGSNSGNTATLTISRVEDGDEADYYCQVWDSSSDVVFGGGTKLTVL

SEQ ID NO: 665 - protein, 10 aa, Artificial Sequence
  Synthetic
QVWDSSSDVV

SEQ ID NO: 666 - protein, 124 aa, Artificial Sequence
  Synthetic
QVQLQESGPGLVKPSQTLSLTCTVSGGSISSGDYYWSWIRQPPGKGLEWIGYIYYSGTTYYNPSLKSRVTISVDTSKNQFSLKLSSVTAADTAVYYCARVMRVFGSGSRAFDIWGQGTKVTVSS

SEQ ID NO: 667 - protein, 16 aa, Artificial Sequence
  Synthetic
ARVMRVFGSGSRAFDI

SEQ ID NO: 668 - protein, 109 aa, Artificial Sequence
  Synthetic
QSVLTQPASVSGSPGQSITISCTGTTSDVGSYDLVSWYQHHPGKAPKLMIYEVSKRPSGVSNRFSGSKSGNTASLTISGLQAEDEADYYCCSYVGSSVLFGGGTKLTVL

SEQ ID NO: 669 - protein, 9 aa, Artificial Sequence
  Synthetic
CSYVGSSVL

SEQ ID NO: 670 - protein, 122 aa, Artificial Sequence
  Synthetic
QVQLVQSGAEVKKPGASVKVSCKASGYTFTSYDINWVRQATGQGLEWMGWMNPNSGNTAYAQKFQGRVTMTRNTSVSTAYMELSSLRSEDTAVYYCARATRSGSYSFVMDVWGQGTTVSVSS

SEQ ID NO: 671 - protein, 15 aa, Artificial Sequence
  Synthetic
ARATRSGSYSFVMDV

SEQ ID NO: 672 - protein, 110 aa, Artificial Sequence
  Synthetic
SYVLTQPPSVSVAPGQTARITCGGNNIGSKNVHWYQQKPGQAPVLVVYDDSDRPSGIPERFSGSNSGNTATLTISRVEAGDEADYYCQVWDSSSDHPLVVFGGGTKLTVL

SEQ ID NO: 673 - protein, 13 aa, Artificial Sequence
  Synthetic
QVWDSSSDHPLVV

SEQ ID NO: 674 - protein, 126 aa, Artificial Sequence
  Synthetic
EVQLVESGGGLVPPGRSLRLSCAASGFTFGDYAMSWFRQAAGKGLEWVGFIRKKAYGGTTEYAASVKGRFTISRDDSKSIAYLQMNSLKTEDTAVYYCTRGITIFGVADDYYMDVWGQGITVTVSS

SEQ ID NO: 675 - protein, 17 aa, Artificial Sequence
  Synthetic
TRGITIFGVADDYYMDV

SEQ ID NO: 676 - protein, 106 aa, Artificial Sequence
  Synthetic
SYVLTQPPSVSVSPGQTARITCSGDALPKQYAYWYQQKPGQAPVLVIYKDSERPSGIPERFSGSSSGTTVTLTISGVQAEDEADYYCQSADSSGIVFGGGTKLTVL

SEQ ID NO: 677 - protein, 9 aa, Artificial Sequence
  Synthetic
QSADSSGIV

SEQ ID NO: 678 - protein, 124 aa, Artificial Sequence
  Synthetic
QVQLVQSGAEVKKPGSSVKVSCKASGGTFSSYAISWVRQAPGQGLEWMGRIIPILAIANYAQKFQGRVTITADKSTSTAYMELSSLRSEDTAVYYCARVVGYSGSGSSYYMDVWGQGTTVTVSS

SEQ ID NO: 679 - protein, 17 aa, Artificial Sequence
  Synthetic
ARVVGYSGSGSSYYMDV

SEQ ID NO: 680 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKAGTSASLAITGLQAEDEADYYCQSYDSSLSGSVFGGGTKLTVL

SEQ ID NO: 681 - protein, 11 aa, Artificial Sequence
  Synthetic
QSYDSSLSGSV

SEQ ID NO: 682 - protein, 119 aa, Artificial Sequence; identical to SEQ ID NO: 73
  Synthetic

SEQ ID NO: 683 - protein, 13 aa, Artificial Sequence
  Synthetic
ARAHYYVTSDFDY

SEQ ID NO: 684 - protein, 111 aa, Artificial Sequence; identical to SEQ ID NO: 74
  Synthetic

SEQ ID NO: 685 - protein, 12 aa, Artificial Sequence
  Synthetic
AAWDDSLNGHVV

SEQ ID NO: 686 - protein, 129 aa, Artificial Sequence
  Synthetic
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDDRYYDYVWGSDRYLLPADYWGQGTLVTVSS

SEQ ID NO: 687 - protein, 22 aa, Artificial Sequence
  Synthetic
ARDDRYYDYVWGSDRYLLPADY

SEQ ID NO: 688 - protein, 110 aa, Artificial Sequence
  Synthetic
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNLVFGGGTKLTVL

SEQ ID NO: 689 - protein, 10 aa, Artificial Sequence
  Synthetic
SSYAGSNNLV

SEQ ID NO: 690 - protein, 123 aa, Artificial Sequence
  Synthetic
QVQLVQSGAEVKKPGASVKVSCKASGYTFTSYGISWMRQAPGQGLEWMGWIDAYNGYTNYAQKLQGRVTMTTDTSTSTAYMELRSLRSDDTAIYYCARAPTPGTYFLYYFDYWGQGTLVTVSS

SEQ ID NO: 691 - protein, 16 aa, Artificial Sequence
  Synthetic
ARAPTPGTYFLYYFDY

SEQ ID NO: 692 - protein, 108 aa, Artificial Sequence
  Synthetic
SYVLTQPPSVSVSPGQTARITCSGDALPKQYGYWYQQKPGQAPVLVIYKDSERPSGIPERFSGSSSGTTVTLTISGVQAEDEADYYCQSADSSGTFVVFGGGTKLTVL

SEQ ID NO: 693 - protein, 11 aa, Artificial Sequence
  Synthetic
QSADSSGTFVV

SEQ ID NO: 694 - protein, 119 aa, Artificial Sequence
  Synthetic
EVQLVQSGAEVKKPGESLKISCKASGYSFISYWIGWVRQMPGKGLEWMGIIYPGDSDTDYSPSFQGQVTISADKSISTAYLQWSSLKASDTAMYYCARRPSLGGWFDPWGQGTLVTVSS

SEQ ID NO: 695 - protein, 12 aa, Artificial Sequence
  Synthetic
ARRPSLGGWFDP

SEQ ID NO: 696 - protein, 110 aa, Artificial Sequence
  Synthetic
QSVLTQPPSASGTPGQRVTISCSGSSSNIGGNPVNWYQQLPGTAPKLLIYNNNQRPSGVPDRFSGSKSGTSASLAISGLQSEDEADYYCEAWDDSLSGVVFGGGTKLTVL

SEQ ID NO: 697 - protein, 11 aa, Artificial Sequence
  Synthetic
EAWDDSLSGVV

SEQ ID NO: 698 - protein, 125 aa, Artificial Sequence; identical to SEQ ID NO: 69
  Synthetic

SEQ ID NO: 699 - protein, 18 aa, Artificial Sequence
  Synthetic
ARDGCSSTSCPEINWFDP

SEQ ID NO: 700 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDGSSDHVVFGGGTKLTVL

SEQ ID NO: 701 - protein, 11 aa, Artificial Sequence
  Synthetic
QVWDGSSDHVV

SEQ ID NO: 702 - protein, 131 aa, Artificial Sequence
  Synthetic
QVQLVQSGAEVKKPGASVKVSCKASGYTFTAYYMHWVRQAPGHGLEWMGWINPNSGGTNYAQKFQGRVTMTRDTSISTAYMELSRLRSDDTAVYYCARAPDDNSAYYFGPGPGQQYYLDFWGQGALVTVSS

SEQ ID NO: 703 - protein, 24 aa, Artificial Sequence
  Synthetic
ARAPDDNSAYYFGPGPGQQYYLDF

SEQ ID NO: 704 - protein, 105 aa, Artificial Sequence
  Synthetic
SYVLTQPPSVSVSPGQTANITCSGDKLGDKYASWYQQKPGQSPVLVIYQDAKRPSGIPERFSGSNSGNTATLTISGTQAMDEADYYCQAWDSSVVFGGGTKLTVL

SEQ ID NO: 705 - protein, 8 aa, Artificial Sequence
  Synthetic
QAWDSSVV

SEQ ID NO: 706 - protein, 129 aa, Artificial Sequence
  Synthetic
QVQLQESGPGLVKPSETLSLTCSVSGGAISSYYWSWIRQPPGKGLEWIGYIYYSGSTNYNPSLKSRVTISVDSSKNQFSLKLNSVTAADTAVYYCARRSYSSSWSISRGNHYYYFMDVWGQGTTVTVSS

SEQ ID NO: 707 - protein, 23 aa, Artificial Sequence
  Synthetic
ARRSYSSSWSISRGNHYYYFMDV

SEQ ID NO: 708 - protein, 110 aa, Artificial Sequence
  Synthetic
QSVLTQPPSVSAAPGQKVTISCSGSSSNFGNNYVSWYQQLPGTAPKLLIYDDNKRPSGIPDRFSGSKSGTSATLGITGLQTGDEAHYYCGTWDGSLSAEVFGTGTRVTVL

SEQ ID NO: 709 - protein, 11 aa, Artificial Sequence
  Synthetic
GTWDGSLSAEV

SEQ ID NO: 710 - protein, 120 aa, Artificial Sequence
  Synthetic
EVQLVESGGGLVQPGGSLRLSCAASGFTFSTYLMSWVRQAPGKGLEWVANINQDGSEKYYVDSVKGRFTISRDIAKNSLYLQMNSLRAEDTAVYYCARGGAGWYVGIDYWGQGTLVTVSS

SEQ ID NO: 711 - protein, 13 aa, Artificial Sequence
  Synthetic
ARGGAGWYVGIDY

SEQ ID NO: 712 - protein, 110 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDTGNWVFGGGTKLTVL

SEQ ID NO: 713 - protein, 9 aa, Artificial Sequence
  Synthetic
QSYDTGNWV

SEQ ID NO: 714 - protein, 129 aa, Artificial Sequence
  Synthetic
EVQLVESGGGLVQPGRSLRLSCTVSGFTFGDYAMSWFRQAPGKGLEWVGFIRSKVYGGTTESAASVKGRFTISRHDSKSIAYLQMNNLKTEDTAVYYCTRLGREETVVGWLDYYYMDVWGQGTTVTVSS

SEQ ID NO: 715 - protein, 20 aa, Artificial Sequence
  Synthetic
TRLGREETVVGWLDYYYMDV

SEQ ID NO: 716 - protein, 111 aa, Artificial Sequence
  Synthetic
QSVLTQPPSVSGAPGQRVTISCTGSSSNIGAGYDVHWYQQLSGTAPKLLIYGNSNRPSGVPDRFSGSKSGTSASLAITGLQAEDEADYYCQSYDSSLSGVVFGGGTKLTVL

SEQ ID NO: 717 - protein, 11 aa, Artificial Sequence
  Synthetic
QSYDSSLSGVV

SEQ ID NO: 718 - protein, 130 aa, Artificial Sequence
  Synthetic
QVQLVESGGGVVQPGRSLRLSCAASGFTFSTYGMHWVRQAPGKGLEWVAVIWYDGSNKDYADSVKGRFTISRDNSKNTLYLQMNSLRAEDTAVYYCARGRYYYDSSGYYQRYETEAFDIWGQGTMVTVSS

SEQ ID NO: 719 - protein, 23 aa, Artificial Sequence
  Synthetic
ARGRYYYDSSGYYQRYETEAFDI

SEQ ID NO: 720 - protein, 107 aa, Artificial Sequence
  Synthetic
DIQMTQSPSTLSASVGDRVTITCRASQSISTWLAWYQQKPGKAPNLLIYKASSLESGVPSRFSGSGSGTEFTLTISSLQPDDFATYYCQQYNSYSYTFGQGTKLEIK

SEQ ID NO: 721 - protein, 9 aa, Artificial Sequence
  Synthetic
QQYNSYSYT

SEQ ID NO: 722 - protein, 129 aa, Artificial Sequence
  Synthetic
QVQLVESGGGVVQPGRSLRLSCAASGFTFSNYGMHWVRQAPGKGLEWVAVILYDGSNKYYADSVKGRFTISRDNSKNTLYLQMNSLRAEDTAVYYCAKRGGAWALYCGGDCYSGPFDYWGQGTLVTVSS

SEQ ID NO: 723 - protein, 22 aa, Artificial Sequence
  Synthetic
AKRGGAWALYCGGDCYSGPFDY

SEQ ID NO: 724 - protein, 105 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLFTFGQGTREIK

SEQ ID NO: 725 - protein, 8 aa, Artificial Sequence
  Synthetic
QQYDNLFT

SEQ ID NO: 726 - protein, 132 aa, Artificial Sequence; identical to SEQ ID NO: 43
  Synthetic

SEQ ID NO: 727 - protein, 25 aa, Artificial Sequence
  Synthetic
AIERYCTNGVCSAPGPSYYYYAMDV

SEQ ID NO: 728 - protein, 106 aa, Artificial Sequence; identical to SEQ ID NO: 44
  Synthetic

SEQ ID NO: 729 - protein, 8 aa, Artificial Sequence
  Synthetic
QQYDNLPL

SEQ ID NO: 730 - protein, 125 aa, Artificial Sequence; identical to SEQ ID NO: 59
  Synthetic

SEQ ID NO: 731 - protein, 18 aa, Artificial Sequence
  Synthetic
AKVNSQYSSDWYDRAFDY

SEQ ID NO: 732 - protein, 106 aa, Artificial Sequence; identical to SEQ ID NO: 60
  Synthetic

SEQ ID NO: 733 - protein, 8 aa, Artificial Sequence
  Synthetic
QQYNSYWT

SEQ ID NO: 734 - protein, 123 aa, Artificial Sequence
  Synthetic
QVQLVESGGGVVQPGRSLRLSCVASGFTFSSYGMHWVRQAPGKGLEWVAVISYDGSNKYYADSVKGRFTMSRDNSKNTLYLQVNSLRTEDTAVYYCAKNSYSYAYGHLGIDYWGQGTLVTVSS

SEQ ID NO: 735 - protein, 16 aa, Artificial Sequence
  Synthetic
AKNSYSYAYGHLGIDY

SEQ ID NO: 736 - protein, 111 aa, Artificial Sequence
  Synthetic
DIVMTQTPLSLSVTPGQPASISCKSSQSLLHSDGQTYLYWYLQKPGQSPQLLIYEISSRFSGVPDRFSGSGSGTDFTLIISRVEAEDVGVYYCMQGIHLPYTFGQGTKLEI

SEQ ID NO: 737 - protein, 9 aa, Artificial Sequence
  Synthetic
MQGIHLPYT

SEQ ID NO: 738 - protein, 122 aa, Artificial Sequence; identical to SEQ ID NO: 57
  Synthetic

SEQ ID NO: 739 - protein, 15 aa, Artificial Sequence
  Synthetic
AKDRYAGPYSSSSDY

SEQ ID NO: 740 - protein, 107 aa, Artificial Sequence; identical to SEQ ID NO: 58
  Synthetic

SEQ ID NO: 741 - protein, 9 aa, Artificial Sequence
  Synthetic
QQYDNLPVT

SEQ ID NO: 742 - protein, 127 aa, Artificial Sequence
  Synthetic
QVQLVESGGGVVQPGRSLRLSCAASGFTFSNYAMHWVRQAPGMGLEWVAVISFDGSNKYYADPVKGRFTISRDNSKNTLYLQMNSLRAEDTAVYYCARDHEWALDIVLMVSGCLDYWGQGTLVTVSS

SEQ ID NO: 743 - protein, 20 aa, Artificial Sequence
  Synthetic
ARDHEWALDIVLMVSGCLDY

SEQ ID NO: 744 - protein, 106 aa, Artificial Sequence
  Synthetic
DIQMTQSPSLSASVGDRVTITCRASQSISSYLNWYQQKPGKAPKLLIYAASSLQSGVPSRFSGSGSGTDFTLTISSLQPEDFATYYCQQSYSTPWTFGQGTKVEIK

SEQ ID NO: 745 - protein, 9 aa, Artificial Sequence
  Synthetic
QQSYSTPWT

SEQ ID NO: 746 - protein, 119 aa, Artificial Sequence
  Synthetic
EVQLVESGGGLVQPGGSLRLSCAASGFTFSSYWMHWVRQGPGKGLVWVSRINSDGKSADYADSVKGRFTVSRDNAKNTLNLQMNSLRAEDTAVYYCAIGGSSSSFWWLLLLRYTVTVSS

SEQ ID NO: 747 - skipped

SEQ ID NO: 748 - protein, 108 aa, Artificial Sequence
  Synthetic
DIQMTQSPSSLSASVGDRVTITCQASHNITNYLNWCQQKPGKAPKLLIYDASNLETGVPSRFSGSGSGTEFTFTISSLQPEDIATYYCQQYHNLPSLTFGGGTKVEIK

SEQ ID NO: 749 - protein, 10 aa, Artificial Sequence
  Synthetic
QQYHNLPSLT

SEQ ID NO: 750 - protein, 121 aa, Artificial Sequence
  Synthetic
QVQLVESGGGVVQPGRSLRLSCAASGFTFSTYVMHWVRQAPGKGLEWVAVISYDGSINSYADSVKGRFTISRDNSKNTLYLQMNSLRAEDTAVYYCARDMLNSRVTVFDYWGQGTLVTVSS

SEQ ID NO: 751 - protein, 14 aa, Artificial Sequence
  Synthetic
ARDMLNSRVTVFDY

SEQ ID NO: 752 - protein, 108 aa, Artificial Sequence
  Synthetic
DIQMTQSPSSLSASVGDRVTITCRASQSISSYLNWYQQKPGKAPKLLISAASSLQSGVPSRFSGSGSGTDFTLTISSLQPEDFATYYCQQSYSTPGLTFGGGTKVEIK

SEQ ID NO: 753 - protein, 10 aa, Artificial Sequence
  Synthetic
QQSYSTPGLT

SEQ ID NO: 754 - protein, 115 aa, Artificial Sequence; identical to SEQ ID NO: 65
  Synthetic

SEQ ID NO: 755 - protein, 9 aa, Artificial Sequence
  Synthetic
ARVVPGNED

SEQ ID NO: 756 - protein, 108 aa, Artificial Sequence
  Synthetic
EIVLTQSPVSLSLSPGERATLSCRASQSVSSYLAWYQQKPGQAPRLLIYDASNRATGIPARFSGSGSGTDFTLTISSLEPEDFAVYYCQQRSNWPEGTFGGGTKVEIK

SEQ ID NO: 757 - protein, 10 aa, Artificial Sequence
  Synthetic
QQRSNWPEGT

SEQ ID NO: 758 - protein, 118 aa, Artificial Sequence
  Synthetic
EVQLVESGGGLIQPGGSLRLSCAAFGVTVRSNYMSWVRQAPGKGLEWVSVIYSGGSTFYADSVKGRFTISRDNSKNTLYFQMNSLRAEDTAVYYCARGGGHYYGMDVWGQGTTVTVSS

SEQ ID NO: 759 - protein, 12 aa, Artificial Sequence
  Synthetic
ARGGGHYYGMDV

SEQ ID NO: 760 - protein, 108 aa, Artificial Sequence; identical to SEQ ID NO: 68
  Synthetic

SEQ ID NO: 761 - protein, 10 aa, Artificial Sequence
  Synthetic
QQLNSYPPYT

SEQ ID NO: 762 - protein, 128 aa, Artificial Sequence; identical to SEQ ID NO: 51
  Synthetic

SEQ ID NO: 763 - protein, 21 aa, Artificial Sequence
  Synthetic
ARGGYCTSTSCYKGFPNWFDP

SEQ ID NO: 764 - protein, 106 aa, Artificial Sequence
  Synthetic
EIVLTQSPSLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 765 - protein, 9 aa, Artificial Sequence
  Synthetic
QQRSNWPIT

SEQ ID NO: 766 - protein, 123 aa, Artificial Sequence; identical to SEQ ID NO: 63
  Synthetic

SEQ ID NO: 767 - protein, 16 aa, Artificial Sequence
  Synthetic
ARVKGRSSYYYYGMDV

SEQ ID NO: 768 - protein, 106 aa, Artificial Sequence
  Synthetic
DIQMTQSPSSLSASVGDRVTITCRASQNIYIYLNWYQQKPGKAPKVLIYGASSLQSGVPSRFSGSGSGTDFTLTISSLQPEDCATYYCQQSYSTPVTFGPGTTVDK

SEQ ID NO: 769 - protein, 9 aa, Artificial Sequence
  Synthetic
QQSYSTPVT

SEQ ID NO: 770 - protein, 123 aa, Artificial Sequence
  Synthetic
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARHSGATSYYYYGMDVWGQGTTVTVSS

SEQ ID NO: 771 - protein, 16 aa, Artificial Sequence
  Synthetic
ARHSGATSYYYYGMDV

SEQ ID NO: 772 - protein, 107 aa, Artificial Sequence
  Synthetic
DIQMTQSPSSLSASVGDRVTITCRASQSISSYLNWYQQKPGKAPKLLIYGASSLQSGVPSRFSGSGSGTDFTLTISSLQPEDFATYYCQQSYSTPGTFGQGTKVEIK

SEQ ID NO: 773 - protein, 9 aa, Artificial Sequence
  Synthetic
QQSYSTPGT

SEQ ID NO: 774 - protein, 122 aa, Artificial Sequence; identical to SEQ ID NO: 41
  Synthetic

SEQ ID NO: 775 - protein, 16 aa, Artificial Sequence
  Synthetic
ARARGGTAMAPYYFDY

SEQ ID NO: 776 - protein, 108 aa, Artificial Sequence; identical to SEQ ID NO: 42
  Synthetic

SEQ ID NO: 777 - protein, 10 aa, Artificial Sequence
  Synthetic
QQSYITPHLT

SEQ ID NO: 778 - protein, 122 aa, Artificial Sequence
  Synthetic
EVQLVESGGGLVQPGGSLRLSCAASGFTFSSYDMHWVRQATGKGLEWVSLIGTAGDTYYPGSVKGRFTISRENAKNSLYLQMNSLRAGDTAVYYCVRANYDSSGYYGYFDYWGQGTLVTVSS

SEQ ID NO: 779 - protein, 16 aa, Artificial Sequence
  Synthetic
VRANYDSSGYYGYFDY

SEQ ID NO: 780 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYNTPPLTFGGGTKVEIK

SEQ ID NO: 781 - protein, 10 aa, Artificial Sequence
  Synthetic
QQSYNTPPLT

SEQ ID NO: 782 - protein, 127 aa, Artificial Sequence
  Synthetic
QVQLQESGPGLVKPSQTLSLTCTVSGGSISNGGYYWSWIRQHPEKGLEWIGYIYYSGSPFYNPSLKSRITMSVDSSKNQFSLKLGSVTAADTAVYYCARTYYYDSSGNYFQYYFDYWGQGTLVTVSS

SEQ ID NO: 783 - protein, 19 aa, Artificial Sequence
  Synthetic
ARTYYYDSSGNYFQYYFDY

SEQ ID NO: 784 - protein, 108 aa, Artificial Sequence
  Synthetic
EIVLTQSPGTLSLSPGERATLSCRASQSVSSDYLAWYQQKPGQAPRLLMYGASSRATGIPDRFSGSGSGTDFTLTISRLEPEDFAVYYCQQYAFSPLTFGGGTKVEIK

SEQ ID NO: 785 - protein, 9 aa, Artificial Sequence
  Synthetic
QQYAFSPLT

SEQ ID NO: 786 - protein, 126 aa, Artificial Sequence
  Synthetic
QVQLVESGGGVVQPGRSLRLSCAGSGFTFSSYAMHWVRQAPGKGLEWVAVISDDGSNKYYVDSVKGRFTISRDNSKNTLYLQMNRLRAEDTAVYYCARDGGSLMVRGVMAPPFDYWGQGTLVTVSS

SEQ ID NO: 787 - protein, 19 aa, Artificial Sequence
  Synthetic
ARDGGSLMVRGVMAPPFDY

SEQ ID NO: 788 - protein, 107 aa, Artificial Sequence
  Synthetic
DIQMTQSPSSLSASVGDRVTITCQASQDISNYLNWYQQKPGKAPKLLIYHASNLETGVPSRFSGSGSGTDFTFTISSLQPEDIATYYCQQYDNLPVTFGPGTKVDIK

SEQ ID NO: 789 - protein, 9 aa, Artificial Sequence
  Synthetic
QQYDNLPVT

SEQ ID NO: 790 - protein, 121 aa, Artificial Sequence
  Synthetic
QVQLQESGPGLVKPSQTLSLTCTVSGGSISSGGYYWSWIRQHPGKGLEWIGSIYYSGNTYSNPSLKSRVIISVDSSNNQFSLNLSSVTAADSAVYFCARDFGGSATYFGYWGRGTLVTVSS

SEQ ID NO: 791 - protein, 13 aa, Artificial Sequence
  Synthetic
ARDFGGSATYFGY

SEQ ID NO: 792 - protein, 107 aa, Artificial Sequence
  Synthetic
DIQMTQSPSSLSASVGDRVTITCQASQDISNYLSWYQQKPGKAPNLLIYDASNLETGVPSRFSGSGSGTDFTFTISSLQPEDIATYYCQQYDNLPPTFGGGTKVEIK

SEQ ID NO: 793 - protein, 9 aa, Artificial Sequence
  Synthetic
QQYDNLPPT

SEQ ID NO: 794 - protein, 127 aa, Artificial Sequence
  Synthetic
QVQLVESGGGLVKPGGSLRLSCAASGFTFSDYYMTWIRQAPGKGLEWVSYITSTSSFTNYADSVRGRFTISRDYAKNSLYLQMTSLRAEDTAVYYCARVFLRSAYPSSRVVWAFDIWGQGTMVTVSA

SEQ ID NO: 795 - protein, 20 aa, Artificial Sequence
  Synthetic
ARVFLRSAYPSSRVVWAFDI

SEQ ID NO: 796 - protein, 106 aa, Artificial Sequence
  Synthetic
DIQMTQSPSSLSASVGDRVTITCQASQDISNYLNWYQQKPGKAPKLLIYDASNLETGVPSRFSGSGSGTDFTFIISSLQPEDIATYYCQQYDLGVTFGPGTKVDLK

SEQ ID NO: 797 - protein, 8 aa, Artificial Sequence
  Synthetic
QQYDLGVT

SEQ ID NO: 798 - protein, 119 aa, Artificial Sequence; identical to SEQ ID NO: 53
  Synthetic

SEQ ID NO: 799 - protein, 13 aa, Artificial Sequence
  Synthetic
ARGGRWLQTVFDL

SEQ ID NO: 800 - protein, 108 aa, Artificial Sequence; identical to SEQ ID NO: 54
  Synthetic

SEQ ID NO: 801 - protein, 10 aa, Artificial Sequence
  Synthetic
QQSYSMPPVT

SEQ ID NO: 802 - protein, 127 aa, Artificial Sequence; identical to SEQ ID NO: 61
  Synthetic

SEQ ID NO: 803 - protein, 20 aa, Artificial Sequence
  Synthetic
ARSQYYYDRSGYANHDAFDI

SEQ ID NO: 804 - protein, 108 aa, Artificial Sequence; identical to SEQ ID NO: 62
  Synthetic

SEQ ID NO: 805 - protein, 10 aa, Artificial Sequence
  Synthetic
QQYNSYLTWT

SEQ ID NO: 806 - protein, 128 aa, Artificial Sequence
  Synthetic
QLQLQESGPGLVKPSETLSLTCTVSGGSISSSSYYWGWIRQPPGKGLEWIGSIFYSGSTYYNPSLKSRVTISVDTSKNHFSLKLSSVTAADTAVYYCARHILYCGRTSCYNFGWFDPWGQGTLVTVSS

SEQ ID NO: 807 - protein, 20 aa, Artificial Sequence
  Synthetic
ARHILYCGRTSCYNFGWFDP

SEQ ID NO: 808 - protein, 106 aa, Artificial Sequence
  Synthetic
DIQMTQSPSTLSASVGDRVTITCRASQSISSWLAWYQQKPGKAPKFLIYKASSLESGVPSRFSGSGSGTEFTLTISSLQPDDFATYYCQQYNSYSTFGQGTKVEIK

SEQ ID NO: 809 - protein, 8 aa, Artificial Sequence
  Synthetic
QQYNSYST

SEQ ID NO: 810 - protein, 127 aa, Artificial Sequence
  Synthetic
QVQLVQSGAEVKKPGASVKVSCKASGYTFTNYGISWVRQAPGQGLEWMGWISVYKGNTNYAQKLQGRVTMTTDTSTGTAYMELRSLRSDDTAVYYCARLVAVAGLDDYNYYYGMDVWGQGTTVTVSS

SEQ ID NO: 811 - protein, 20 aa, Artificial Sequence
  Synthetic
ARLVAVAGLDDYNYYYGMDV

SEQ ID NO: 812 - protein, 107 aa, Artificial Sequence
  Synthetic
SYELTQPFSVSVSPGQTARITCSGDAFPKQYAYWYQQKPGQAPVLVIYKDSERPSGIPERFSGSSSGTTVTLTISGVQAEDEADYYCQSPDSSGTYVFGTGTKVTVL

SEQ ID NO: 813 - protein, 10 aa, Artificial Sequence
  Synthetic
QSPDSSGTYV

SEQ ID NO: 814 - protein, 119 aa, Artificial Sequence; identical to SEQ ID NO: 107
  Synthetic

SEQ ID NO: 815 - protein, 12 aa, Artificial Sequence
  Synthetic
ARHDSSYVPPGL

SEQ ID NO: 816 - protein, 110 aa, Artificial Sequence; identical to SEQ ID NO: 108
  Synthetic

SEQ ID NO: 817 - protein, 11 aa, Artificial Sequence
  Synthetic
AAWDDSLNGYV

SEQ ID NO: 818 - protein, 127 aa, Artificial Sequence
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEFYDFWSGYLYYYYGMDVWGQGTTVTVSS

SEQ ID NO: 819 - protein, 20 aa, Artificial Sequence
  Synthetic
AKEFYDFWSGYLYYYYGMDV

SEQ ID NO: 820 - protein, 111 aa, Artificial Sequence
  Synthetic
QSVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTHVVFGGGTKLTVL

SEQ ID NO: 821 - protein, 11 aa, Artificial Sequence
  Synthetic
SSYTSSSTHVV

SEQ ID NO: 822 - protein, 124 aa, Artificial Sequence
  Synthetic
QVQLVQSGAEVKKPGSSVKVSCKASGGTFSSYAISWVRQAPGQGLEWMGGIIPIFGTAKYAQKFQGRVTITAEEATSTAYMEVSSRSEDTAVYYCARDDYGTLWAHYYYGMVVWGQGTTVTVSS

SEQ ID NO: 823 - protein, 18 aa, Artificial Sequence
  Synthetic
ARDDYGTLWAHYYYGMVV

SEQ ID NO: 824 - protein, 109 aa, Artificial Sequence
  Synthetic
QSVLTQEPSFSVSPGGTVTLTCGLSSGSVSTSYYPSWFQQTPGQAPRTLIYSTNTRSSGVPDRFSGSVLGNKAALTITGAQSDDESDYYCVLYMGSGKVVFGGGTKLTV

SEQ ID NO: 825 - protein, 10 aa, Artificial Sequence
  Synthetic
VLYMGSGKVV

SEQ ID NO: 826 - protein, 126 aa, Artificial Sequence
  Synthetic
EVQLVESGGGLVQPGGSLRLSCAASGFTFSSHSMHWVRQAPGKGLEWVSYISSSRTTIFYADSVKGRFTISRDNAENSLYLQMNSLRAEDTAVYYCAREQPPAYCAGDCLAAFDVWGQGTMVTVSS

SEQ ID NO: 827 - protein, 19 aa, Artificial Sequence
  Synthetic
AREQPPAYCAGDCLAAFDV

SEQ ID NO: 828 - protein, 109 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDVSGDHLYVFGTGTKVTVL

SEQ ID NO: 829 - protein, 12 aa, Artificial Sequence
  Synthetic
QVWDVSGDHLYV

SEQ ID NO: 830 - protein, 118 aa, Artificial Sequence
  Synthetic
QVQLVESGGGVVQPGRSLRLSCAASGFTFSSYGMHWVRQAPGRGLEWVALIWSDGSNKFYADSVKGRFTISRDNSKNTLYLQMNSLRAEDTAVYFCARGMAAAATDFWGQGTLVTVSS

SEQ ID NO: 831 - protein, 11 aa, Artificial Sequence
  Synthetic
ARGMAAAATDF

SEQ ID NO: 832 - protein, 108 aa, Artificial Sequence
  Synthetic
SYVLTQAPSVSVAPGKTARITCGGNNIGSQSVHWYQQKPGQAPVLVIYFDTDRPSGIPERFSGSNSGNTATLTISRVEAGDEADYYCQVSDSSSDHVLFGGGTKLTVL

SEQ ID NO: 833 - protein, 11 aa, Artificial Sequence
  Synthetic
QVSDSSSDHVL

SEQ ID NO: 834 - protein, 124 aa, Artificial Sequence
  Synthetic
QMQLVQSGPEVKKPGTSVKVSCKASGFTFSRSAVQWVRQARGQRLEWIGWILVGSGNTNYAQKFQERVTITRDMSTSTAYMELRSLRSEDTAVYYCAADREVPAAIPLNWFDPWGQGTLVTVSS

SEQ ID NO: 835 - protein, 17 aa, Artificial Sequence
  Synthetic
AADREVPAAIPLNWFDP

SEQ ID NO: 836 - protein, 105 aa, Artificial Sequence
  Synthetic
SYELTQPPSVSVSPGQTARITCSGDALPMQYACWYQQKPGQAPVLVIFNDIERPSGIPERFSGSTSGTTVTLTISGVQAEDEADYYCQSADSSVVFGGGTKLTVL

SEQ ID NO: 837 - protein, 8 aa, Artificial Sequence
  Synthetic
QSADSSVV

SEQ ID NO: 838 - protein, 124 aa, Artificial Sequence
  Synthetic
QVQLVESGGGVVQPGRSLRLSCAASGFTFSSYGMHWVRQAPGKGLEWVAFISYDGSNKYYADSVKGRFTISRDNSKNTLYLQMNSLRAEDTAVYYCAKGPWYSSSWYTYYFDYWGQGTLVTVSS

SEQ ID NO: 839 - protein, 17 aa, Artificial Sequence
  Synthetic
AKGPWYSSSWYTYYFDY

SEQ ID NO: 840 - protein, 112 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVSYVFGTGTKVTVL

SEQ ID NO: 841 - protein, 12 aa, Artificial Sequence
  Synthetic
QSYDSSLSVSYV

SEQ ID NO: 842 - protein, 130 aa, Artificial Sequence
  Synthetic
QVQLQESGPGLVKPSQTLSLTCTVSGGSISSSGYYWSWIRQRPGKGLEWIGFIYYSGTTYSNPSLKSRVTISVDTSENQFSLNLSSVTAADTAVYYCARETRYDSSGFTSPGLLGGWDYWGQGTLVTVSS

SEQ ID NO: 843 - protein, 22 aa, Artificial Sequence
  Synthetic
ARETRYDSSGFTSPGLLGGWDY

SEQ ID NO: 844 - protein, 110 aa, Artificial Sequence
  Synthetic
QSVLTQPASVSGSPGQSITISCTGTSSDVGGYNYVSWYQQHPGKAPKLMIYGVSNRPSGVSNRFSGSKSGNTASLTISGLQAEDEADYYCSSYTTSSTRVFGGGTKLTVL

SEQ ID NO: 845 - DNA, 10 bp, Artificial Sequence
  Synthetic
ssyttsstrv

SEQ ID NO: 846 - protein, 118 aa, Artificial Sequence
  Synthetic
QVQLVESGGGVVQPGRSLRLSCAASGFTFSTYGMHWVRQAPGKGLEWVAIIWNDGSNKFYGDSVKGRFTISRDNSKNTLYLQMNSLRAEDTGVYYCARGAAGGLVQHWGQGTLVTVSS

SEQ ID NO: 847 - protein, 11 aa, Artificial Sequence
  Synthetic
ARGAAGGLVQH

SEQ ID NO: 848 - protein, 108 aa, Artificial Sequence
  Synthetic
SYVLTQPPSVSVAPGKTARITCGGNYIGTNSVHWYQQKPGQAPVLVIFYDSDRPSGIPERFSGSNSGNTATLTINRVEAGDEADYYCQVWDSSSDHLVFGGGTKLTVL

SEQ ID NO: 849 - protein, 11 aa, Artificial Sequence
  Synthetic
QVWDSSSDHLV

SEQ ID NO: 850 - protein, 127 aa, Artificial Sequence
  Synthetic
QVQLVESGGGVVQPGRSLRLSCAASGFTFSSYAMHWVRQAPGKGLEWVAIIWYDGSNEYYADSVKGRFTISRDNSKNTLYVQMNSLRAEDTAVYYCARDRGYFNRTGNYYVGRFDPWGQGTLVTVSS

SEQ ID NO: 851 - protein, 20 aa, Artificial Sequence
  Synthetic
ARDRGYFNRTGNYYVGRFDP

SEQ ID NO: 852 - protein, 108 aa, Artificial Sequence
  Synthetic
SYVLTQPPSVSVAPGQTATITCGGNNIGSKSVHWYQQRPGQAPVLVVFDDSDRPSGIPERFSGSNSGNTATLTISRVEAGDEADYYCKVWDSSSDHLVFGRGTKLTVL

SEQ ID NO: 853 - protein, 11 aa, Artificial Sequence
  Synthetic
KVWDSSSDHLV

SEQ ID NO: 854 - protein, 117 aa, Artificial Sequence
  Synthetic
QVQLVQSGAEVKKPGASVKVSCKASGYTFTSYYIHWVRQAPGQGLQWMGVINPNGGSAQKFQGRVTMTRDTSTSTVYMEMSSLTSEDTAVYYCAREGSTGTAFLDYWGQGTLVTVSS

SEQ ID NO: 855 - protein, 13 aa, Artificial Sequence
  Synthetic
AREGSTGTAFLDY

SEQ ID NO: 856 - protein, 109 aa, Artificial Sequence
  Synthetic
SYVLTQPPSVSVAPGQTARITCGENDIGSKSVHWYQQKPRQAPVLVVYDDSDRPSGIPERFSGSNSGNTATLTISRVDAGDEADYYCQVWDGSSGHHVVFGGGTKLTVL

SEQ ID NO: 857 - protein, 12 aa, Artificial Sequence
  Synthetic
QVWDGSSGHHVV

SEQ ID NO: 858 - protein, 120 aa, Artificial Sequence; identical to SEQ ID NO: 109
  Synthetic

SEQ ID NO: 859 - protein, 13 aa, Artificial Sequence
  Synthetic
ARIYSSSDNGMDV

SEQ ID NO: 860 - protein, 110 aa, Artificial Sequence; identical to SEQ ID NO: 110
  Synthetic

SEQ ID NO: 861 - protein, 11 aa, Artificial Sequence
  Synthetic
AAWDDSLNGWV

SEQ ID NO: 862 - protein, 119 aa, Artificial Sequence
  Synthetic
EVQLVQSGAEVKKPGESLKISCKGSGYSFTSYWIGWVRQMPGKGLEWMGIIYPGDSDTRYSPSFQGQVTISADRSFSTAYLQWSSLKASDTAMYYCARLVSGWNSFDLWGQGTLVTVSS

SEQ ID NO: 863 - protein, 12 aa, Artificial Sequence
  Synthetic
ARLVSGWNSFDL

SEQ ID NO: 864 - protein, 109 aa, Artificial Sequence
  Synthetic
QSVLTQEPSLTVSPGGTVTLTCGSSTRAVTSGHYPYWFQQKPGQAPRTLIYDTSNTHSWTPARFSGSLLGGKAALILSGAQPEDEADYYCLLSHSAAWVFGGGTKLTVL

SEQ ID NO: 865 - protein, 9 aa, Artificial Sequence
  Synthetic
LLSHSAAWV

SEQ ID NO: 866 - protein, 121 aa, Artificial Sequence
  Synthetic
QVQLQESGPGLVKPSQTLSLTCTVSGGSISSGGFYWSWIRQHPGEGLEWFGYIDYSGSTYYNPSLKSRVTISADTSKKQFSLRLSSVTAADTAVYYCARGIVGATSWFDPWGQGTLVTVSS

SEQ ID NO: 867 - protein, 13 aa, Artificial Sequence
  Synthetic
ARGIVGATSWFDP

SEQ ID NO: 868 - protein, 108 aa, Artificial Sequence
  Synthetic
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTKLTVL

SEQ ID NO: 869 - protein, 11 aa, Artificial Sequence
  Synthetic
QVWDSSSDHPV

SEQ ID NO: 870 - protein, 125 aa, Artificial Sequence
  Synthetic
QVQLVQSGAEVKKPGSSVKVSCKASGGTFSRYAISWVRQAPGQGLEWMGGIIPIFGTPNYAQKFQGRVTITADESTSTAYMELSSLRSDDTAVYYCARDDYGTLWAHYYYGMDVWGQGTTVTVSS

SEQ ID NO: 871 - protein, 18 aa, Artificial Sequence
  Synthetic
ARDDYGTLWAHYYYGMDV

SEQ ID NO: 872 - protein, 109 aa, Artificial Sequence
  Synthetic
QSVTQEPSFSVSPGGTVTLTCGLSSGSVSTAYYPSWFQQTPGQAPRTLISSTNTRSSGVPDRFSGSILGNKAALTITGAQADDESDYYCVLFMGSGMVVFGGGTKLTVL

SEQ ID NO: 873 - protein, 10 aa, Artificial Sequence
  Synthetic
VLFMGSGMVV

SEQ ID NO: 874 - protein, 122 aa, Artificial Sequence
  Synthetic
QVQLQESGPGLVKPSGTLSLTCAVSGGSISSSNWWSWVRQPPGKGLEWIGEIDHSGSTNYNVSLKSRVTISVDKSKNQFSLKLSSVTAADTAVYYCAGVGDSDYFYYGMDVWGQGTTVTVSS

SEQ ID NO: 875 - protein, 15 aa, Artificial Sequence
  Synthetic
AGVGDSDYFYYGMDV

SEQ ID NO: 876 - protein, 108 aa, Artificial Sequence
  Synthetic
QSVLTQPRSVSGSPGQSVAISCTGTSSDVGGYNYVSWYQQHPGKAPKLMIYDVSKRPSGVPDRFSGSKSGNTASLTISGLQADDEADYYCCSYAGSYVFGTGTKVTVL

SEQ ID NO: 877 - protein, 8 aa, Artificial Sequence
  Synthetic
CSYAGSYV

SEQ ID NO: 878 - protein, 120 aa, Artificial Sequence
  Synthetic
EVQLVQSGAEVKKPGESLTISCKGSGYRFTSYWISWVRQMPGKGLEWMGRIDPSDSHTKYSPSFEGHVTMSADRSISTAYLQWSSLKASDTAMYYCARQMCGGDCDPDYWGQGTLVTVSS

SEQ ID NO: 879 - protein, 13 aa, Artificial Sequence
  Synthetic
ARQMCGGDCDPDY

SEQ ID NO: 880 - protein, 110 aa, Artificial Sequence
  Synthetic
QSVLTQPASVSGSPGQSITISCAGTSSDFGVYNYVSWYQQHPGKAPKLMIYDVSHRPSGVSNRFSGSKSGNTASLTISGLQAEDEADYYCSSYTRSSTLVFGGGTKLTVL

SEQ ID NO: 881 - protein, 10 aa, Artificial Sequence
  Synthetic
SSYTRSSTLV

SEQ ID NO: 882 - protein, 117 aa, Artificial Sequence
  Synthetic
EVQLVESGGGLGRSLRLSCTAAGFTFGDYSMSWFRQAPGKGLEWVGFIRSKAYGGTTEYAASVKGRFTISRDDAKSIGYLQMNSLKTEDTAVYYCTRDLWPVGFDPWGQGTLVTVSS

SEQ ID NO: 883 - protein, 11 aa, Artificial Sequence
  Synthetic
TRDLWPVGFDP

SEQ ID NO: 884 - protein, 106 aa, Artificial Sequence
  Synthetic
SYVLTQPPSVSVSPGQTASITCSGDKLGDKYACWYQQKPGQSPVMVISQDTKRPSGIPERFSGSNSGNTATLTISGTQAMDEADYYCQAWDSSTVVFGGGTKLTVL

SEQ ID NO: 885 - protein, 9 aa, Artificial Sequence
  Synthetic
QAWDSSTVV

SEQ ID NO: 886 - protein, 120 aa, Artificial Sequence; identical to SEQ ID NO: 115
  Synthetic

SEQ ID NO: 887 - protein, 13 aa, Artificial Sequence
  Synthetic
AKGPPPSWGGFDQ

SEQ ID NO: 888 - protein, 107 aa, Artificial Sequence
  Synthetic
SYVLTQPPSVSVSPGQTASITCSGDKLRDQYACWYQQKPGQSPVLVIYQDSKRPSGIPERFSGSNSGNTATLTISGTQAMDEADYYCQAWDSTTLWVFGGGTKLTVL

SEQ ID NO: 889 - protein, 10 aa, Artificial Sequence
  Synthetic
QAWDSTTLWV

SEQ ID NO: 890 - protein, 119 aa, Artificial Sequence
  Synthetic
EVQLVESGGGLVQPGGSLRLSCAASGFTFSSYWMSWVRQAPGKGLEWVANIKEDGSEKYYVDSVKGRFTISRDNAKNSLYLQMNSLRAEDTAVYYCASQFWLRGSFDFGGQGTLVTVSS

SEQ ID NO: 891 - protein, 12 aa, Artificial Sequence
  Synthetic
ASQFWLRGSFDF

SEQ ID NO: 892 - protein, 111 aa, Artificial Sequence
  Synthetic
NFMLTQPHSVSESPGKTVTISCTPSSGSIASNYVQWYQQRPGSAPTTVIYEDNQRPSGVPDRFSGSIDSSSNSASLTISGLKTEDEADYYCQSYDSSILVVFGGGTKLTVL

SEQ ID NO: 893 - protein, 10 aa, Artificial Sequence
  Synthetic
QSYDSSILVV

SEQ ID NO: 894 - protein, 120 aa, Artificial Sequence
  Synthetic
QVQLQESGPGLVKPSQTLSLTCTVSGGSISSGGYYWSWIRQHPGKGLEWIGYIDYSGSTYYNPSLKSRVTISVDTSKNQFSLKLTSVTAADTAVYYCARAIYGSGLFDYWGQGTLVTVSS

SEQ ID NO: 895 - protein, 12 aa, Artificial Sequence
  Synthetic
ARAIYGSGLFDY

SEQ ID NO: 896 - protein, 108 aa, Artificial Sequence
  Synthetic
SYVLTQPPSVSVAPGKTARITCGGNNIGSKSVHWYQQKPGQAPVLVIYYDSDRPSGIPERFSASNSGNTATLTISRVEAGDEADYYCQVWDSSSDHPVFGGGTKLTVL

SEQ ID NO: 897 - protein, 11 aa, Artificial Sequence
  Synthetic
QVWDSSSDHPV

SEQ ID NO: 898 - protein, 126 aa, Artificial Sequence
  Synthetic
EVQLLESGGGLVQPGGSLRLSCAASGFNFRHFAMSWVRQAPGKGLEWVSAIGDRGDSTNYADSVKGRFTISRDNSKNTFYLQMNSLRAEDTAVYYCAKLRGIGELLEVYHYGLDVWGQGTTVTVSS

SEQ ID NO: 899 - protein, 19 aa, Artificial Sequence
  Synthetic
AKLRGIGELLEVYHYGLDV

SEQ ID NO: 900 - protein, 106 aa, Artificial Sequence
  Synthetic
SYVLTQPPSVSVSPGQTASITCSGDKLGNKYTCWYQLRPGQSPVLVIYQDTKRPSGIPERFSASNSGNTATLTISGTQAMDEADYYCQAWDSRTYVFGTGTKVTVL

SEQ ID NO: 901 - protein, 9 aa, Artificial Sequence
  Synthetic
QAWDSRTYV

SEQ ID NO: 902 - protein, 123 aa, Artificial Sequence
  Synthetic
QVQLVESGGGVVQPGRSLRLSCAASGFSFSRHGMHWVRQAPGKGLEWVAVVWFDGSSTYYGDSVKGRFTISRDNSKNTMYLQMNSLRAEDTAVYYCAREIGCSGGSCDSFDIWGQGTMVTVSS

SEQ ID NO: 903 - protein, 16 aa, Artificial Sequence
  Synthetic
AREIGCSGGSCDSFDI

SEQ ID NO: 904 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDRVVFGGGTKLTVL

SEQ ID NO: 905 - protein, 10 aa, Artificial Sequence
  Synthetic
VWDSSSDRVV

SEQ ID NO: 906 - protein, 122 aa, Artificial Sequence
  Synthetic
QVQLQESGPGLMKPSGTLSLTCAVSGGSISSNNWWSWVRQPPGKGLEWIGEIDHSGSTNYNPSLRSRVTILVDKSKNQFSLKLSSVTAADTAVYYCASVGTADYFYYGMDVWGQGTTVTVSS

SEQ ID NO: 907 - protein, 15 aa, Artificial Sequence
  Synthetic
ASVGTADYFYYGMDV

SEQ ID NO: 908 - protein, 108 aa, Artificial Sequence
  Synthetic
QSVLTQPRSVSGSPGQSVTISCTGTSSDVGGYNYVSWYQQYPGKAPKLMIYDVSKRPSGVPDRFSGSKSGNTASLTISGLQAEDEADFYCCSYAGSYTFGGGTKLTVL

SEQ ID NO: 909 - skipped

SEQ ID NO: 910 - protein, 125 aa, Artificial Sequence
  Synthetic
QVQLQESGPGLVKPSQTLSLTCTVSGGSISSGGSYWSWIRQHPGKGLEWIGYIYYSGTTYYNPSLKSRVTISVDTSKNQFSLKLSSVTAADTAVYYCARLRLRFLEWWHSGMDVWGQGTTVTVSS

SEQ ID NO: 911 - protein, 17 aa, Artificial Sequence
  Synthetic
ARLRLRFLEWWHSGMDV

SEQ ID NO: 912 - protein, 110 aa, Artificial Sequence
  Synthetic
QSALTQPASVSGSPGQSITISCTGTSSDVGGYNYVSWYQQHPGKAPKLMIYEVSYRPSGVSNRFSGSKSGNTASLTISGLQAEDEADYYCSSYTSNSTMIFGGGTKLTVL

SEQ ID NO: 913 - protein, 10 aa, Artificial Sequence
  Synthetic
SSYTSNSTMI

SEQ ID NO: 914 - protein, 122 aa, Artificial Sequence
  Synthetic
EVQLVQSGAEVKKPGESLRISCKGSGYSFTSYWITWVRQMPGKGLEWMGKIDPSDSYTKYSPSFQGHVTISADKSINTAYLQWSSLKASDTAMYFCARLVTGVTTGDCFDPWGQGTLVTVSS

SEQ ID NO: 915 - protein, 15 aa, Artificial Sequence
  Synthetic
ARLVTGVTTGDCFDP

SEQ ID NO: 916 - protein, 110 aa, Artificial Sequence
  Synthetic
QSVLTQPASVSGSPGQSITISCTGSSSDVGSYNFVSWYQQHPGKAPKFLIYEGSERPSGVSTRFSVSKSGNTASLTISGLQAEDEADYYCCSYARSSTYVFGTGTKVSVL

SEQ ID NO: 917 - protein, 10 aa, Artificial Sequence
  Synthetic
CSYARSSTYV

SEQ ID NO: 918 - protein, 123 aa, Artificial Sequence; identical to SEQ ID NO: 95
  Synthetic

SEQ ID NO: 919 - protein, 16 aa, Artificial Sequence
  Synthetic
AKCFYSYGYPCYYFDY

SEQ ID NO: 920 - protein, 111 aa, Artificial Sequence; identical to SEQ ID NO: 96
  Synthetic

SEQ ID NO: 921 - protein, 10 aa, Artificial Sequence
  Synthetic
QSCDSNNLWV

SEQ ID NO: 922 - protein, 122 aa, Artificial Sequence
  Synthetic
QVQLVESGGGVVQPGRSLRLSCSASGFTFSNYGMHWVRQAPGKGLEWVAAIWYDGSNKYYADSVKGRFTISRDNSKNTLYLQMNTLRAEDTAVYYCARTPRWELLATIFDYWGQGTLVTVSS

SEQ ID NO: 923 - protein, 15 aa, Artificial Sequence
  Synthetic
ARTPRWELLATIFDY

SEQ ID NO: 924 - protein, 110 aa, Artificial Sequence
  Synthetic
NFMLTQPHSVSESPGKTVTISCTRSSGSIASNYVQWYQQRPGSAPTTVIYEHSQRPSGVPDRFSGSIDSSSNSASLTISGLKTEDEADYYCQSYDSTRAVFGGGTKLTVL

SEQ ID NO: 925 - protein, 9 aa, Artificial Sequence
  Synthetic
QSYDSTRAV

SEQ ID NO: 926 - protein, 130 aa, Artificial Sequence
  Synthetic
QVQLVESGGGVVQPGRSLRLSCAASGFTFSNYGMHWVRQAPGKGLEWVAVIWYDGSNKYYADSVKGRFTISRDNSKNTLYLQMNSLRAEDTAVYYCARDLGVVQVAEPDDYFYYYGMDVWGQGTTVTVSS

SEQ ID NO: 927 - protein, 23 aa, Artificial Sequence
  Synthetic
ARDLGVVQVAEPDDYFYYYGMDV

SEQ ID NO: 928 - protein, 108 aa, Artificial Sequence
  Synthetic
SYVLTQPPSVSVSPGQTARITCSGDAFPKQYGYWYQQKPGQAPVLVIYKDNERPSGIPERFSGSSSGTTVTLTISGVQAEDEADYYCQSADSSGRSRVFGGGTKLTVL

SEQ ID NO: 929 - protein, 11 aa, Artificial Sequence
  Synthetic
QSADSSGRSRV

SEQ ID NO: 930 - protein, 133 aa, Artificial Sequence
  Synthetic
QVQLVESGGGVVQPGRSLRLSCAASRFTFSTYGMHWVRQAPGKGLEWVALISDDGSNKYYADSVKGRFTISRDNSKNTLYLQMNSLRAEDTAVYYCAKDLSWRSVVVVLPSAPTYYYYGMDVWGQGTTVTVSS

SEQ ID NO: 931 - protein, 26 aa, Artificial Sequence
  Synthetic
AKDLSWRSVVVVLPSAPTYYYYGMDV

SEQ ID NO: 932 - protein, 111 aa, Artificial Sequence
  Synthetic
QSVLTQPPSASGTPGQRVSISCSGSSSNIGGNPVNWYQQLPGTAPKLLIYSNNQRPSGVPDRFSGSKSGTSASLAISGLQSEDEADYYCSTWDDSLNGFYVFGTGTKVTVL

SEQ ID NO: 933 - protein, 12 aa, Artificial Sequence
  Synthetic
STWDDSLNGFYV

SEQ ID NO: 934 - protein, 120 aa, Artificial Sequence
  Synthetic
QVQLVQSGAEVRKPGASVKVSCKASGYTFTSYYMHWVRQAPGQGLEWMGIIYPSGGSTGYAQKFQGRVTMTRDTSTSTVYMELSSLKSEDTAVYFCAREGERGTVVLDYWGQGTLVTVSS

SEQ ID NO: 935 - protein, 13 aa, Artificial Sequence
  Synthetic
AREGERGTVVLDY

SEQ ID NO: 936 - protein, 109 aa, Artificial Sequence
  Synthetic
SYVLTQPPSVSVAPGQTARITCGDTNIGSKSVHWYQQKPGQAPVLVVYDDSDRPSGIPERFSGSNSGNTATLTISRVEAGDEADYYCQVWDGSSDRHVVFGGGTKLTVL

SEQ ID NO: 937 - protein, 12 aa, Artificial Sequence
  Synthetic
QVWDGSSDRHVV

SEQ ID NO: 938 - protein, 131 aa, Artificial Sequence
  Synthetic
QVQLVQSGAEVKKPGASVKVSCKASGYTFTSYGISWVRQAPGQGLEWMAWISPYNGNTDYAQKLQGRVIMTTDTATSTAYMELRSLRSDDTAVYYCARDLGKKYDSSGYSYYYYYNGMDVWGQGTTVTVSS

SEQ ID NO: 939 - protein, 24 aa, Artificial Sequence
  Synthetic
ARDLGKKYDSSGYSYYYYYNGMDV

SEQ ID NO: 940 - protein, 110 aa, Artificial Sequence
  Synthetic
QSVLTQPPSASGSPGQSVTISCTGTSSDVGDYNYVSWYQQHPGKAPKLMIYEVTKRPSGVPDRFSGSKSGNTASLTVSGLQAEDEADYYCSSYAGSNNLVFGGGTYLTVL

SEQ ID NO: 941 - protein, 10 aa, Artificial Sequence
  Synthetic
SSYAGSNNLV

SEQ ID NO: 942 - protein, 124 aa, Artificial Sequence
  Synthetic
QVQLVQSGAEVKKPGASVKVSCKASGYTFIRYYIHWVRQAPGQGLEWMGIINPSGGSTTYAQKFQGRVTMTRDTSTSTVYMELSSLRSEDTAVFYCARDMVAGNHVDWGNFDFWGQGTLVTVSS

SEQ ID NO: 943 - protein, 17 aa, Artificial Sequence
  Synthetic
ARDMVAGNHVDWGNFDF

SEQ ID NO: 944 - protein, 110 aa, Artificial Sequence
  Synthetic
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTFLFGGGTKLTVL

SEQ ID NO: 945 - protein, 10 aa, Artificial Sequence
  Synthetic
SSYTSSSTFL

SEQ ID NO: 946 - protein, 123 aa, Artificial Sequence
  Synthetic
QVQLVESGGGVVQPGRSLRLSCAASGFTFSSYAMHWVRQAPGKGLEWVALISYDGSDKYYADSVKGRFTISRDNSKNTQYLQMNSLRAEDTAVYYCAKNMGSYGYYYYGMDVWGQGTTVTVSS

SEQ ID NO: 947 - protein, 16 aa, Artificial Sequence
  Synthetic
AKNMGSYGYYYYGMDV

SEQ ID NO: 948 - protein, 110 aa, Artificial Sequence
  Synthetic
QSVLTQPPSASGSPGQSVTISCTGSSSDVGGYNSVSWYQLHPGKAPKLMIYEVFERPSGVPDRFSGSKSGKTASLTVSGLQAEDEADYYCSSFAGSNTWVFGGGTKLTVL

SEQ ID NO: 949 - protein, 10 aa, Artificial Sequence
  Synthetic
SSFAGSNTWV

SEQ ID NO: 950 - protein, 126 aa, Artificial Sequence
  Synthetic
EVQLVQSGAEVKKPGESLKISCKGSGYSFISSWIGWVRQKPGKGLEWLGIIYPGDFDTRYSPSFQGQVTISADKSISTAYLQWSSLKASDTALYYCATSGGSWNYGRSPLDAFDIWGQGTMVTVSS

SEQ ID NO: 951 - protein, 19 aa, Artificial Sequence
  Synthetic
ATSGGSWNYGRSPLDAFDI

SEQ ID NO: 952 - protein, 110 aa, Artificial Sequence
  Synthetic
QSVLTQSPSASGTPGQRVTISCSGSSSNIGSNTVNWFQQFPGTAPKLLIYSNNQRPSGVPDRFSGSKSGTSASLAISGLQSEDEADYYCAAWDDSLNGQVFGGGTKLTVL

SEQ ID NO: 953 - protein, 11 aa, Artificial Sequence
  Synthetic
AAWDDSLNGQV

SEQ ID NO: 954 - protein, 123 aa, Artificial Sequence
  Synthetic
QVQLQESGPGLVKPSQTLSLTCTVSGGSISSGGYYWSWIRQHPGKGLEWIGYIYYSGSTYYKPSLKSRVTISVDTSKNQFSLKLRSVTAADTAVYYCARDWGPPVGRNWFDPWGQGTLVTVSS

SEQ ID NO: 955 - protein, 15 aa, Artificial Sequence
  Synthetic
ARDWGPPVGRNWFDP

SEQ ID NO: 956 - protein, 108 aa, Artificial Sequence
  Synthetic
SYVLTQPPSVSVAPGQTARITCGGNEIGSKNVHWYQQKPGQAPVLVVYDDSDRPSGIPERFSGSNSGNTATLTISRVEAGDEADYYCQVWDSSSDPYVFGTGTKVTVL

SEQ ID NO: 957 - protein, 11 aa, Artificial Sequence
  Synthetic
QVWDSSSDPYV

SEQ ID NO: 958 - protein, 128 aa, Artificial Sequence
  Synthetic
QVQLVESGGGVVQPGRSLRLSCAASGFTFSRYGMDWVRQAPGKGLEWVAVISYDGGNEYYADSVKGRFTISRDNSKNTLYLQMNSLRAEDTALYYCAKVNGPYCGGGNCYGDSAFDYWGQGTLVTVSS

SEQ ID NO: 959 - protein, 21 aa, Artificial Sequence
  Synthetic
AKVNGPYCGGGNCYGDSAFDY

SEQ ID NO: 960 - protein, 108 aa, Artificial Sequence
  Synthetic
SYVLTQPPSVSVAPGKTARITCGGNNIGSKSVHWYQQKPGQAPVVVIYYDSDRPSGIPERFSGSNSGNTATLTISRVEAGDEADYYCQVWDRSSDHWVFGGGTKLTVL

SEQ ID NO: 961 - protein, 11 aa, Artificial Sequence
  Synthetic
QVWDRSSDHWV

SEQ ID NO: 962 - protein, 120 aa, Artificial Sequence
  Synthetic
EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKDRSSSPFYFDYWGQGTLVTVSS

SEQ ID NO: 963 - protein, 13 aa, Artificial Sequence
  Synthetic
VKDRSSSPFYFDY

SEQ ID NO: 964 - protein, 109 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHFWVFGGGTKLTVL

SEQ ID NO: 965 - protein, 12 aa, Artificial Sequence
  Synthetic
QVWDSSSDHFWV

SEQ ID NO: 966 - protein, 122 aa, Artificial Sequence
  Synthetic
QVQLVQSGAEVKKPGASVKVSCKASGYTFTTYYIHWVRQAPGQGLEWMGIINPGAGSTSYAQKFQGRVTMTRDTSTSTVYMELSSLRSEDTAVYYCARGGIVPAATENFDLWGRGTLVIVSS

SEQ ID NO: 967 - protein, 15 aa, Artificial Sequence
  Synthetic
ARGGIVPAATENFDL

SEQ ID NO: 968 - protein, 108 aa, Artificial Sequence
  Synthetic
SYVLTQPPSVSEAPGQTARITCGGNKIGSKRVHWYQQKPGQAPVLVVYDDSDRPSGIPERFSGSNSGNTATLTISRVEVGDEADYYCQVWDRSSDHWVFGGGTKLTVL

SEQ ID NO: 969 - protein, 11 aa, Artificial Sequence
  Synthetic
QVWDRSSDHWV

SEQ ID NO: 970 - protein, 120 aa, Artificial Sequence
  Synthetic
QVQLVQSGAEVKKPGASVKVSCKASGYTFTSYHMHWVRQAPGQGLEWMGIINPSGGSASYAQKFQGRVTMTRDTSTSTVYMALSSLRFEDTAVYYCARSHSVAVAGTIFWGQGTLVTVSS

SEQ ID NO: 971 - protein, 13 aa, Artificial Sequence
  Synthetic
ARSHSVAVAGTIF

SEQ ID NO: 972 - protein, 111 aa, Artificial Sequence
  Synthetic
QSVLTQEPSLTVSPGGTVTLTCASSTGAVTSGYFPNWFQQKPGQAPRALIYSTGNKHSWTPARFSGSLLGGKAALTLSGVQPEDEAEYYCLLYYGDTQLWVFGGGTKLTVL

SEQ ID NO: 973 - protein, 11 aa, Artificial Sequence
  Synthetic
LLYYGDTQLWV

SEQ ID NO: 974 - protein, 120 aa, Artificial Sequence; identical to SEQ ID NO: 75
  Synthetic

SEQ ID NO: 975 - protein, 13 aa, Artificial Sequence
  Synthetic
AREGSTGTTFLDY

SEQ ID NO: 976 - protein, 109 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCHVWDGSSDHHVVFGGGTKLTVL

SEQ ID NO: 977 - protein, 12 aa, Artificial Sequence
  Synthetic
HVWDGSSDHHVV

SEQ ID NO: 978 - protein, 120 aa, Artificial Sequence; identical to SEQ ID NO: 105
  Synthetic

SEQ ID NO: 979 - protein, 13 aa, Artificial Sequence
  Synthetic
ARGRLGVVLGVDY

SEQ ID NO: 980 - protein, 109 aa, Artificial Sequence
  Synthetic
NFMLTQPHSVSESPGKTVTISCTRSSGSIASNYVQWYQQRPGSSPTTVIYEDNQRPSGVPDRFSGSMDSSSNSASLTISGLKTEDEADYCQSYDSSNWVFGGGTKLTVL

SEQ ID NO: 981 - protein, 9 aa, Artificial Sequence
  Synthetic
QSYDSSNWV

SEQ ID NO: 982 - protein, 122 aa, Artificial Sequence
  Synthetic
QLQLQESGPGLVKPSETLSLNCTVSGGSISSSSYFWAWIRQPPGKGLEWIGSIYSSGSTYYNPSLKSRVTISVDTSKNQFSLKLSSVTAADTAVYYCARRRPGYELWYFHLWGRGTLVTVSS

SEQ ID NO: 983 - protein, 14 aa, Artificial Sequence
  Synthetic
ARRRPGYELWYFHL

SEQ ID NO: 984 - protein, 111 aa, Artificial Sequence
  Synthetic
QSVLTQPPSVSGAPGQRVTISCTGSSSNIGAGYDVHWYQQLPGTAPKLLIYVNNNRPSGVPDRFSGSKSGTSASLAITGLQAEDEADYYCQSYDTSLSGSVFGGGTKLTVL

SEQ ID NO: 985 - protein, 11 aa, Artificial Sequence
  Synthetic
QSYDTSLSGSV

SEQ ID NO: 986 - protein, 123 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVFYCAKGITIVGATTEYFDYWGQGTLVTVSS

SEQ ID NO: 987 - protein, 16 aa, Artificial Sequence
  Synthetic
AKGITIVGATTEYFDY

SEQ ID NO: 988 - protein, 109 aa, Artificial Sequence
  Synthetic
SYVLTQPPSVSVAPGQTARITCGGNSIGSKSVHWYQQKPGQAPVLVVFDDSDRPSGIPERFSGSNSGNTATLTISRVEAGDEADYYCQVWDGSSDHPWVFGGGTKLTVL

SEQ ID NO: 989 - protein, 12 aa, Artificial Sequence
  Synthetic
QVWDGSSDHPWV

SEQ ID NO: 990 - protein, 122 aa, Artificial Sequence
  Synthetic
EVQLVESGGGLVQPGGSLRLSCSASGFSFSSYAMHWVRQAPGKGLEYVSAISSNGGSTYYADSVRGRFIISRDNSKNALYLQMSSLRAEDTAVYYCVKGLGGFAPPYWHFDLWGRGTLVTVS

SEQ ID NO: 991 - protein, 16 aa, Artificial Sequence
  Synthetic
VKGLGGFAPPYWHFDL

SEQ ID NO: 992 - protein, 111 aa, Artificial Sequence
  Synthetic
QSVLTQPPSVSGAPGQRVTISCTGSSSNIGAGYDVHWYQQLPGTAPKLLMYGNTNRPSGVPDRFSGSKSGTSASLAITGLQAEDEADYYCQSYDSSLSGPVFGGGTKLTVL

SEQ ID NO: 993 - protein, 11 aa, Artificial Sequence
  Synthetic
QSYDSSLSGPV

SEQ ID NO: 994 - protein, 128 aa, Artificial Sequence
  Synthetic
QVQLVESGGGVVQPGRSLRLSCAASGFTFSDYGMHWVRQAPGKGLEWVALIWYGGRNNYYADSVKGRFTISRDNSKNTLYLQMNSLRAEDTAVYYCARDLYRQELADDYYFYYGMDVWGLGTTVTVSS

SEQ ID NO: 995 - protein, 21 aa, Artificial Sequence
  Synthetic
ARDLYRQELADDYYFYYGMDV

SEQ ID NO: 996 - protein, 108 aa, Artificial Sequence
  Synthetic
SYVLTQPPSVSVSPGQTASITCSGEKWGDKYACWFQQKPGQSPVLVIYQDSKRPSGIPERISGSNSGNKATLTISGTQAMDEADYYCQAWDRNTAHVVFGGGTKLTVL

SEQ ID NO: 997 - protein, 11 aa, Artificial Sequence
  Synthetic
QAWDRNTAHVV

SEQ ID NO: 998 - protein, 114 aa, Artificial Sequence
  Synthetic
EVQLVESGGGLIQPGGSLRLSCAASGLTVSSNYMSWVRQAPGKGLEWVSAIYSGGSTFYADSVKGRFTISRDNSKNTLYLQMNSLRAEDTAVYYCARELRNWKWGQGTLVTVSS

SEQ ID NO: 999 - protein, 8 aa, Artificial Sequence
  Synthetic
ARELRNWK

SEQ ID NO: 1000 - protein, 107 aa, Artificial Sequence
  Synthetic
DIQMTQSPSSLSASVGDRVTITCQASQDIRNYLNWYQQKPGKAPKLLIYDASNLETGVPSRFSGSGSGTDFTFTISSLQPEDIATYYCQQYDNLPQTFGQGTKLEIK

SEQ ID NO: 1001 - protein, 9 aa, Artificial Sequence
  Synthetic
QQYDNLPQT

SEQ ID NO: 1002 - protein, 122 aa, Artificial Sequence
  Synthetic
QVQLVQSGAEVKKPGASVKVSCKASGYTFTNYYIHWVRQAPGQGLEWMGIINPGAGSTSYAQKFQGRVTMTTDTSTSTVYMELSSLRSEDTAVYYCARDLGLVPAANSFEYWGQGTLVTVSS

SEQ ID NO: 1003 - protein, 15 aa, Artificial Sequence
  Synthetic
ARDLGLVPAANSFEY

SEQ ID NO: 1004 - protein, 108 aa, Artificial Sequence
  Synthetic
EIVLTQSPATLSLSPGERATLSCRASQSVSGYLAWYQQKPGQAPRLLIYDASNRATGIPARFSGSGSGTDFTLTISSLEPEDFAVYYCQQRSNWPPFTFGQGTRLEIK

SEQ ID NO: 1005 - protein, 10 aa, Artificial Sequence
  Synthetic
QQRSNWPPFT

SEQ ID NO: 1006 - protein, 120 aa, Artificial Sequence; identical to SEQ ID NO: 81
  Synthetic

SEQ ID NO: 1007 - protein, 13 aa, Artificial Sequence
  Synthetic
ATDEGEATTYPGY

SEQ ID NO: 1008 - protein, 108 aa, Artificial Sequence; identical to SEQ ID NO: 82
  Synthetic

SEQ ID NO: 1009 - protein, 10 aa, Artificial Sequence
  Synthetic
QQSYSTPPWT

SEQ ID NO: 1010 - protein, 120 aa, Artificial Sequence
  Synthetic
EVQLLESGGGLVQPGGSLRLSCSASGFTFRTYAVTWVRQAPGKGLECVSAISGSGDDTYYADSVKGRFTISRDNSKNTLYLQMNSLRAEDTAVYYCAKAARSVADYFDSWGQGTLVTVSS

SEQ ID NO: 1011 - protein, 13 aa, Artificial Sequence
  Synthetic
AKAARSVADYFDS

SEQ ID NO: 1012 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQHYNSYPYTFGQGTKLEIK

SEQ ID NO: 1013 - protein, 9 aa, Artificial Sequence
  Synthetic
QHYNSYPYT

SEQ ID NO: 1014 - protein, 123 aa, Artificial Sequence
  Synthetic
QVQLVESGGGVVQPGRSLRLSCAGSGFTLSTYGMHWVRQAPGKGLDWVAVISSDGSNKNYADSVKGRFTISRDNSKNTLYLQMNSLRAEDTAVYYCAKVGPYYYDSDAGFDYWGQGTLVTVSS

SEQ ID NO: 1015 - protein, 16 aa, Artificial Sequence
  Synthetic
AKVGPYYYDSDAGFDY

SEQ ID NO: 1016 - protein, 107 aa, Artificial Sequence
  Synthetic
AIQLTQSPSSLSASVGDRVTITCRASQGISSALAWYQQKPGKAPKLLIYDASTLESGVPSTFSGSGSGTDFTLTISSLQPEDFATYYCQQFNSYPRTFGGGTKVEIK

SEQ ID NO: 1017 - protein, 9 aa, Artificial Sequence
  Synthetic
QQFNSYPRT

SEQ ID NO: 1018 - protein, 126 aa, Artificial Sequence
  Synthetic
EVQLLESGGGLVQPGGSLRLSCAASGFAFTTYATSWVRQAPGKGLEWVSGISASGGSTYYADSVKGRFTISRDNFENTLYLQMHSLRAEDTAVYYCAKVTFRTELKQLIPNYFDYWGQGTLVTVSS

SEQ ID NO: 1019 - protein, 19 aa, Artificial Sequence
  Synthetic
AKVTFRTELKQLIPNYFDY

SEQ ID NO: 1020 - protein, 107 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 1021 - protein, 9 aa, Artificial Sequence
  Synthetic
QQRSNWPLT

SEQ ID NO: 1022 - protein, 118 aa, Artificial Sequence
  Synthetic
QVQLQESGPGLVKPSGTLSLTCAVSGGSISSSNWWSWVRQPPGKGLEWIGEIYHRGSTNYNPSLKSRVTISVDKSKNQFSLKLSSVTAADTAVYYCARDPHRWGLVHWGQGTLVTVSS

SEQ ID NO: 1023 - protein, 11 aa, Artificial Sequence
  Synthetic
ARDPHRWGLVH

SEQ ID NO: 1024 - protein, 107 aa, Artificial Sequence
  Synthetic
DIQMTQSPSTLSASVGDRVTITCRASQSISSWLAWYQQKPGKAPKLLIYEASSLETGVPSRFSGSGSGTEFTLTISSLQPDDFATYYCQQYNSYPYTFGQGTKLEIK

SEQ ID NO: 1025 - protein, 9 aa, Artificial Sequence
  Synthetic
QQYNSYPYT

SEQ ID NO: 1026 - protein, 121 aa, Artificial Sequence
  Synthetic
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARGGHGGSNYPDFDYWGQGTLVTVSS

SEQ ID NO: 1027 - protein, 15 aa, Artificial Sequence
  Synthetic
ARGGHGGSNYPDFDY

SEQ ID NO: 1028 - protein, 107 aa, Artificial Sequence
  Synthetic
DIQLTQSPLSASVGDRVTITCRASQGISNYLAWFQQKPGKAPNLLIYAASTLQSGVPSRFSGSGSGTEFTLTISSLQPEDFATYYCQQLNSYPLMSTFGQGTKLEIK

SEQ ID NO: 1029 - protein, 11 aa, Artificial Sequence
  Synthetic
QQLNSYPLMST

SEQ ID NO: 1030 - protein, 131 aa, Artificial Sequence
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYFCAKDSVLRHYDYVWGSYRPVDYFDYWGQGTLVTVSS

SEQ ID NO: 1031 - protein, 24 aa, Artificial Sequence
  Synthetic
AKDSVLRHYDYVWGSYRPVDYFDY

SEQ ID NO: 1032 - protein, 107 aa, Artificial Sequence
  Synthetic
DIQMTQSPSTLSASVGDRVTITCRASQSITSWLAWYQQKPGKAPKLLIYKASSLESGVPSRFSGSGSGTEFTLTISSLQPDDFATYYCQQYNSYFPTLGQGTKVDIK

SEQ ID NO: 1033 - protein, 9 aa, Artificial Sequence
  Synthetic
QQYNSYFPT

SEQ ID NO: 1034 - protein, 117 aa, Artificial Sequence; identical to SEQ ID NO: 111
  Synthetic

SEQ ID NO: 1035 - protein, 11 aa, Artificial Sequence
  Synthetic
ARSYGDYYLDF

SEQ ID NO: 1036 - protein, 107 aa, Artificial Sequence; identical to SEQ ID NO: 112
  Synthetic

SEQ ID NO: 1037 - protein, 8 aa, Artificial Sequence
  Synthetic
QHYGRTWT

SEQ ID NO: 1038 - protein, 124 aa, Artificial Sequence
  Synthetic
EVQLVESGGGLVQPGGSLRLSCSASGFTFSSFPMHWVRQAPGKGLEYVSAISSNGGSTYYADPVKGRFTISRDNSKNTLYLQMSSLRPEDTAVYYCLKEPKVLVTDAAQVGDYWGQGTLVTVSS

SEQ ID NO: 1039 - protein, 17 aa, Artificial Sequence
  Synthetic
LKEPKVLVTDAAQVGDY

SEQ ID NO: 1040 - protein, 107 aa, Artificial Sequence
  Synthetic
EIVLTQSPATLSLSPGERATLSCRASQGVSSYLAWYQQKPGQAPRLLIYDASNRATGIPARFSGSGSGTDFTLTISSLEPEDFAVYYCQQRTNWPWTFGQGTKVEIK

SEQ ID NO: 1041 - protein, 9 aa, Artificial Sequence
  Synthetic
QQRTNWPWT

SEQ ID NO: 1042 - protein, 117 aa, Artificial Sequence
  Synthetic
EVQLVESGGGLIQPGGSLRLSCAASGVTVSSNYMSWVRQAPGKGLEWVSVIYSGGSTYYADSVKGRFTISRDNSKNTLYLQMNSLRAEDTAVYYCARSGYYDAFDIWGQGTMVTVSS

SEQ ID NO: 1043 - protein, 11 aa, Artificial Sequence
  Synthetic
ARSGYYDAFDI

SEQ ID NO: 1044 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPGFTFGPGTKVDIK

SEQ ID NO: 1045 - protein, 10 aa, Artificial Sequence
  Synthetic
QQLNSYPGFT

SEQ ID NO: 1046 - protein, 120 aa, Artificial Sequence
  Synthetic
EVQLVESGGGLVQPGGSLRLSCAASGFTFSSYDMHWVRQATGKGLEWVSVIGTAGDTYYPDSVKGRFTISRENAKNSLYLQMNSLRAEDTAVYYCVRDHGVGATYAFDIWGQGTMVTVSS

SEQ ID NO: 1047 - protein, 14 aa, Artificial Sequence
  Synthetic
VRDHGVGATYAFDI

SEQ ID NO: 1048 - protein, 108 aa, Artificial Sequence
  Synthetic
DIQMTQSPSSLSASVGDRVTITCRASQSISRYLNWYQQKPGKAPKLLIYVASSLQSGVPSRFSGSGSGTDFTLTISSLQPEDFATYYCQQSYSTPGLTFGGGTKVEIK

SEQ ID NO: 1049 - protein, 10 aa, Artificial Sequence
  Synthetic
QQSYSTPGLT

SEQ ID NO: 1050 - protein, 120 aa, Artificial Sequence
  Synthetic
QVQLVESGGGVVQPGRSLRLSCAASGFTFRNYGMHWVRQAPGNGLEWVAVIWYDGSNKYYADSVKGRFTISRDNSKKMVYLQMNSLRAEDTAVYYCARDPEITVSSMDVWGQGTTVTVSS

SEQ ID NO: 1051 - protein, 13 aa, Artificial Sequence
  Synthetic
ARDPEITVSSMDV

SEQ ID NO: 1052 - protein, 112 aa, Artificial Sequence
  Synthetic
DVVMTQSPLSLPVTVGQPASISCRSSQSLVYIDENTYLSWFQQRPGQSPRRLIYKVSNRDSGVPDRFSGSGSGTDFTLKISRVEAEDVGVYYCMQGTHWPLTFGGGTKVELK

SEQ ID NO: 1053 - protein, 9 aa, Artificial Sequence
  Synthetic
MQGTHWPLT

SEQ ID NO: 1054 - protein, 127 aa, Artificial Sequence
  Synthetic
QVQLVQSGAEVKKPGASVKVSCKASGYTFTNDALHWVRQAPGQRLEWMGWINAGNGNTKYSQKLQGRVTITRDTSASTAYMELSSLRSEDTAVYYCARGHTPGPSYLLQTHDTFDIWGQGTMVTVSS

SEQ ID NO: 1055 - protein, 20 aa, Artificial Sequence
  Synthetic
ARGHTPGPSYLLQTHDTFDI

SEQ ID NO: 1056 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYPWTFGQGTKVEIK

SEQ ID NO: 1057 - protein, 9 aa, Artificial Sequence
  Synthetic
QQYNSYPWT

SEQ ID NO: 1058 - protein, 121 aa, Artificial Sequence; identical to SEQ ID NO: 91
  Synthetic

SEQ ID NO: 1059 - protein, 14 aa, Artificial Sequence
  Synthetic
ARDTVVSPLYGLDV

SEQ ID NO: 1060 - protein, 108 aa, Artificial Sequence
  Synthetic
DIQMTQSPSSLSASVGDRVTITCRASQSISSYLNWYQQKPGKAPKLLIYGATSLQSGVPSRFSGSGSGTDFTLTISSLQPEDFATYYCQQSYSTPRIIFGPGTKVDVK

SEQ ID NO: 1061 - protein, 10 aa, Artificial Sequence
  Synthetic
QQSYSTPRII

SEQ ID NO: 1062 - protein, 123 aa, Artificial Sequence
  Synthetic
EVQLLESGGGLVQPGGSLRLSCAASGFTLSSYAMSWVRQAPGKGLEWVSAISGAGGSTYYADSVKGRFTISRDNSKNTLYLQMNSLRAEDTAVYYCAKLPSGIAAAGYWFDPWGQGTLVTVSS

SEQ ID NO: 1063 - protein, 16 aa, Artificial Sequence
  Synthetic
AKLPSGIAAAGYWFDP

SEQ ID NO: 1064 - protein, 107 aa, Artificial Sequence
  Synthetic
AIWMTQSPSLLPASTGDRVTISCRMSQGISSYLAWYQQKPGKAPELLIHAASTLQSGVPSRFSGSGSGTDFTLTISRLQPEDFATYYCQQYYSFPPTFGQGTKVEIK

SEQ ID NO: 1065 - protein, 9 aa, Artificial Sequence
  Synthetic
QQYYSFPPT

SEQ ID NO: 1066 - protein, 124 aa, Artificial Sequence
  Synthetic
QVQLVESGGGVVQPGRSLSLSCAASGFTFSTYGMHWVRQAPGKGLEWVAVISYDGSDKYYADSVKGRFTISRDNSKNTLYLQMNSLRAEDTAVYYCAKQIASYSSGWLKYFDYWGQGILVTVSS

SEQ ID NO: 1067 - protein, 17 aa, Artificial Sequence
  Synthetic
AKQIASYSSGWLKYFDY

SEQ ID NO: 1068 - protein, 107 aa, Artificial Sequence
  Synthetic
DIQMTQSPSSLSASVGDRVTITCLASQDISNYLIWYQQKPGKAPKLLIYDASNLEAGVPSRFSGSGSGTDFTFTISSLQPEDIATYYCQQYDNLPLTFGQGTKLQIK

SEQ ID NO: 1069 - protein, 9 aa, Artificial Sequence
  Synthetic
QQYDNLPLT

SEQ ID NO: 1070 - protein, 127 aa, Artificial Sequence; identical to SEQ ID NO: 83
  Synthetic

SEQ ID NO: 1071 - protein, 20 aa, Artificial Sequence
  Synthetic
AKSHSTAYSPSTFYYYGLDV

SEQ ID NO: 1072 - protein, 108 aa, Artificial Sequence; identical to SEQ ID NO: 84
  Synthetic

SEQ ID NO: 1073 - protein, 10 aa, Artificial Sequence
  Synthetic
QQSYSTPPFT

SEQ ID NO: 1074 - protein, 125 aa, Artificial Sequence
  Synthetic
EVQLVQSGAEVRKPGESLKISCKASGYTFSNYWIGWVRQKPGKGLEWMGIIYPDDSDTRYSPSFQGQVTISADKSITTAYLQWSNLEASDTAIYYCARHLRPYCAGDCWDWFDPWGQGTLVTVSS

SEQ ID NO: 1075 - protein, 18 aa, Artificial Sequence
  Synthetic
ARHLRPYCAGDCWDWFDP

SEQ ID NO: 1076 - protein, 107 aa, Artificial Sequence
  Synthetic
EIVLTQSPATLSLSPGERATLSCRASQSVSTYLAWYQQKPGQAPRLLIFDASNRATAIPARFSGSGSGTDFTLSISSLEPEDFAVYYCQQRSNWPLTFGGGTKVEIK

SEQ ID NO: 1077 - protein, 9 aa, Artificial Sequence
  Synthetic
QQRSNWPLT

SEQ ID NO: 1078 - protein, 122 aa, Artificial Sequence
  Synthetic
EVQLVQSGAEVKKPGESLKISCKGSGYSFTSYWIGWVRQMPGKGLEWMGSIYPGDSDTRYSPSFQGQVTISADKSISIAYLQWSSLKASDSAMYYCASLNGQVTNIEYFQHWGQGTLVTVSS

SEQ ID NO: 1079 - protein, 15 aa, Artificial Sequence
  Synthetic
ASLNGQVTNIEYFQH

SEQ ID NO: 1080 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYENLSLTFGGGTKVEIK

SEQ ID NO: 1081 - protein, 9 aa, Artificial Sequence
  Synthetic
QQYENLSLT

SEQ ID NO: 1082 - protein, 117 aa, Artificial Sequence
  Synthetic
EVQLLESGGDLVQPGGSLRLSCAASGFTLSSFAMNWVRQFQGRGLEWVAVIGAGRSTIYYADSVKGRFIISRDNSKNTLYLQMNSLRTEDTAVYYCAKDDLSRNDLWGRGTLVTVSS

SEQ ID NO: 1083 - protein, 10 aa, Artificial Sequence
  Synthetic
AKDDLSRNDL

SEQ ID NO: 1084 - protein, 107 aa, Artificial Sequence
  Synthetic
DIQMTQSPSSLSASVGDRVTITCRASQGISDSLAWFQQKPGKAPKSLIYAASSLQSGVPSKFSGSGSGTDFTLTISSLQPEDFATYYCQQYRSFPLTFGGGTKVEIK

SEQ ID NO: 1085 - protein, 9 aa, Artificial Sequence
  Synthetic
QQYRSFPLT

SEQ ID NO: 1086 - protein, 113 aa, Artificial Sequence
  Synthetic
EVQLVESGGGIQPGGSLRLSCAAEFIVSRNYMSWVRQAPGKGLEWVSVIYSGGSTYADSVKGRFTISRDNSKNTLYLQMNSLRAEDTAVYYCARWLKGYFDYWGQGTLVTVSS

SEQ ID NO: 1087 - protein, 10 aa, Artificial Sequence
  Synthetic
ARWLKGYFDY

SEQ ID NO: 1088 - protein, 108 aa, Artificial Sequence
  Synthetic
AIQLTQSPSSLSASVGDRVTITCRASQGISSALAWYQQKPGKAPNLLIYDASSLESGVPSRFSGSGSGTDFTLTISSLQPEDFATYYCQQFNDYPHPLTFGGGTKVDI

SEQ ID NO: 1089 - protein, 11 aa, Artificial Sequence
  Synthetic
QQFNDYPHPLT

SEQ ID NO: 1090 - protein, 120 aa, Artificial Sequence
  Synthetic
EVQLVESGGGLIQPGGSLRLSCAASGFIVSSNYMGWIRQAPGKGLEWVSVLYPGESTYYADSVKGRFTISRDNSKNTLYLQMNSLRAEDTAVYYCARALPATGTEYFDYWGQGTLVTVSS

SEQ ID NO: 1091 - protein, 14 aa, Artificial Sequence
  Synthetic
ARALPATGTEYFDY

SEQ ID NO: 1092 - protein, 108 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYDSYSRLAFGGGTKVEIK

SEQ ID NO: 1093 - protein, 10 aa, Artificial Sequence
  Synthetic
QQYDSYSRLA

SEQ ID NO: 1094 - protein, 123 aa, Artificial Sequence
  Synthetic
QVQLVQSGAEVKKPGASVKVSCKASGNTFTSYYIHWVRQAPGQGLEWMGIINPSAGSTTYAQKFQGRVTMTRDTSTSTVYMELSSLRSEDMAVYYCARGFPVPAASLNWFDPWGQGTLVTVSS

SEQ ID NO: 1095 - protein, 16 aa, Artificial Sequence
  Synthetic
ARGFPVPAASLNWFDP

SEQ ID NO: 1096 - protein, 108 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNWLPYTFGQGTKLEIK

SEQ ID NO: 1097 - protein, 10 aa, Artificial Sequence
  Synthetic
QQYNNWLPYT

SEQ ID NO: 1098 - protein, 128 aa, Artificial Sequence
  Synthetic
EVQLLESGGGLVQPGESLRLSCAASGFTFSDYAMNWVRQAPGRGLEWVSAISGSGAGTFYADSVKGRFTISRDNSKNTLYLQMDSLRAEDTAVYYCANEAGYCTKGLCYFLHNWFDPWGQGTLVIVSS

SEQ ID NO: 1099 - protein, 21 aa, Artificial Sequence
  Synthetic
ANEAGYCTKGLCYFLHNWFDP

SEQ ID NO: 1100 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYNTPPWTFGQGTKVEIK

SEQ ID NO: 1101 - protein, 10 aa, Artificial Sequence
  Synthetic
QQSYNTPPWT

SEQ ID NO: 1102 - protein, 116 aa, Artificial Sequence
  Synthetic
EVQLVESGGGLIQPGGSLRLSCAASGVIVSSNYMSWVRQAPGKGLEWVSVIYSGGSTFYADSVKGRFTISRDNSKNTLYLQMNSLRAEDTAVYYCAREVYEHFDYWGQGTLVTVSS

SEQ ID NO: 1103 - protein, 10 aa, Artificial Sequence
  Synthetic
AREVYEHFDY

SEQ ID NO: 1104 - protein, 106 aa, Artificial Sequence
  Synthetic
DIQLTQSPSFLSASVGDRVTITCRSQGISSYLAWYQQKPGKAPKLLIYAASTLQSGVPSRFSGSGSGTDFTLTISSLQPEDFATYYCQHLNSYPQYTFGQGTKLEI

SEQ ID NO: 1105 - protein, 10 aa, Artificial Sequence
  Synthetic
QHLNSYPQYT

SEQ ID NO: 1106 - protein, 126 aa, Artificial Sequence; identical to SEQ ID NO: 89
  Synthetic

SEQ ID NO: 1107 - protein, 19 aa, Artificial Sequence
  Synthetic
ARVGDSGGYYPAGLDYFDY

SEQ ID NO: 1108 - protein, 110 aa, Artificial Sequence; identical to SEQ ID NO: 90
  Synthetic

SEQ ID NO: 1109 - protein, 11 aa, Artificial Sequence
  Synthetic
QQYGSSPPFVA

SEQ ID NO: 1110 - protein, 120 aa, Artificial Sequence
  Synthetic
QVQLVQSGAEVKKPGASVRVSCKASGYTFTNFHIHWVRQAPGQGLEWMGTINPSGGYTSYAPKFQGRVTMTRDTSTSTVYMELSGLRSEDTALYYCARDIAARDAYFDYWGQGTLVTVSS

SEQ ID NO: 1111 - protein, 13 aa, Artificial Sequence
  Synthetic
ARDIAARDAYFDY

SEQ ID NO: 1112 - protein, 108 aa, Artificial Sequence
  Synthetic
DIQMTQSPSSLSASVGDRVTITCRASQSISSYLNWYQQKPGKAPKLLIFAASSLQSGVPSRFSGSGSGTDFTLTISSLQREDFATYYCQQSYSSPPYTFGQGTKLEIK

SEQ ID NO: 1113 - protein, 10 aa, Artificial Sequence
  Synthetic
QQSYSSPPYT

SEQ ID NO: 1114 - protein, 120 aa, Artificial Sequence; identical to SEQ ID NO: 115
  Synthetic

SEQ ID NO: 1115 - protein, 13 aa, Artificial Sequence
  Synthetic
AKGPPPSWGGFDQ

SEQ ID NO: 1116 - protein, 107 aa, Artificial Sequence
  Synthetic
DVVMTQSPSLTLGQPASISCTSSQSLVYSDGSTYLNWFHQRPGQSPRRLIYKVSNRGVPDRFSGSGSVNDFTLKISRVEAEDVGIYYCMQGTHWPPTFGQGTKLEIK

SEQ ID NO: 1117 - protein, 9 aa, Artificial Sequence
  Synthetic
MQGTHWPPT

SEQ ID NO: 1118 - protein, 127 aa, Artificial Sequence; identical to SEQ ID NO: 87
  Synthetic

SEQ ID NO: 1119 - protein, 20 aa, Artificial Sequence
  Synthetic
AKNAGPYCSAHNCYSGPFDY

SEQ ID NO: 1120 - protein, 106 aa, Artificial Sequence; identical to SEQ ID NO: 88
  Synthetic

SEQ ID NO: 1121 - protein, 8 aa, Artificial Sequence
  Synthetic
QQYYNLPG

SEQ ID NO: 1122 - protein, 127 aa, Artificial Sequence
  Synthetic
QVQLVESGGGVVQPGRSLRLSCAASAFTFSTYGMHWVRQAPGKGLEWVAVISSDGSNQYYADSVKGRFTISRDNSKNTLYLQMNSLRAEDTAVYYCAKSHSSVYSPSTFYYYGMDVWGQGTTVTVSS

SEQ ID NO: 1123 - protein, 20 aa, Artificial Sequence
  Synthetic
AKSHSSVYSPSTFYYYGMDV

SEQ ID NO: 1124 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQLEDFATYYCQQSYSTPPFTFGPGTKVDIK

SEQ ID NO: 1125 - protein, 10 aa, Artificial Sequence
  Synthetic
QQSYSTPPFT

SEQ ID NO: 1126 - protein, 124 aa, Artificial Sequence
  Synthetic
EVQLVQSGAEVKKPGESLKISCKASGDSFTTYWIGWVRQMPGKGLEWMGIIYPGDSDTRYSPSFQGQVTMSVDKSITTAYLQWSSLKASDTAMYYCASLLNIDGYSPFDAFDIWGQGTMVAVSS

SEQ ID NO: 1127 - protein, 17 aa, Artificial Sequence
  Synthetic
ASLLNIDGYSPFDAFDI

SEQ ID NO: 1128 - protein, 109 aa, Artificial Sequence
  Synthetic
EIVLTQSPGTLSLSPGERATLSCRASQSVSSSYLAWYQQKPGQAPRLLIYGASNRATGIPDRFSGSGSGTDFTLTISRLEPEDFAVYYCQQYGSSPPYTFGQGTKLETK

SEQ ID NO: 1129 - protein, 10 aa, Artificial Sequence
  Synthetic
QQYGSSPPYT

SEQ ID NO: 1130 - protein, 121 aa, Artificial Sequence; identical to SEQ ID NO: 99
  Synthetic

SEQ ID NO: 1131 - protein, 15 aa, Artificial Sequence
  Synthetic
ARPRYGSRSYYAGDY

SEQ ID NO: 1132 - protein, 104 aa, Artificial Sequence
  Synthetic
DIQMTQSLSAFVGDRVTITCQASQDINNYLNWYQQKPGKAPKLLIYDTSNLEIGVPSRFSGSGSGTYFTFTISSLQPEDIATYYCQQYDNLPITFGQGTRLEIK

SEQ ID NO: 1133 - protein, 9 aa, Artificial Sequence
  Synthetic
QQYDNLPIT

SEQ ID NO: 1134 - protein, 121 aa, Artificial Sequence
  Synthetic
QVQLVQSGAEVKRPGSSVKVSCKAPGGTFSSYAISWVRQAPGQGLEWMGEIIPLFDTTNYAQKFQGRVTITADESTSTAYMELSSVRSEDTAVYYCARGGGSSGWNWFDPWGQGTLVTVSS

SEQ ID NO: 1135 - protein, 14 aa, Artificial Sequence
  Synthetic
ARGGGSSGWNWFDP

SEQ ID NO: 1136 - protein, 107 aa, Artificial Sequence
  Synthetic
DIQMTQSPSSLSASVGDRVTITCRASQSISTYLNWYQQKPGKAPKLLIYAASSLQSGVPSRFSGSGSGTDFTLSISSLQPEDFATYYCQQSSSTPWTFGQGTKVEIK

SEQ ID NO: 1137 - protein, 9 aa, Artificial Sequence
  Synthetic
QQSSSTPWT

SEQ ID NO: 1138 - protein, 125 aa, Artificial Sequence
  Synthetic
EVQLVQSGAEVKKPGESLKISCKGSGYSFTSYWIGWVRQMPGKGLEWMGIIYPGDSDSRYSPSFQGQVTISADKSISTAYLQWSSLKASDTAMYYCARHLRAYCRGDCYNAFDIWGQGTMVTVSS

SEQ ID NO: 1139 - protein, 18 aa, Artificial Sequence
  Synthetic
ARHLRAYCRGDCYNAFDI

SEQ ID NO: 1140 - protein, 107 aa, Artificial Sequence
  Synthetic
AIQLTQSPSSLSASVGDRVTITCRASQGISSALAWYQQKPGKVPKLLIFDASSLESGVPSRFSGSGSGTDFTLTISSLQPEDFATYYCQQFNSYPPTFGQGTRLEIK

SEQ ID NO: 1141 - protein, 9 aa, Artificial Sequence
  Synthetic
QQFNSYPPT

SEQ ID NO: 1142 - protein, 123 aa, Artificial Sequence
  Synthetic
QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPYCSNGVCHDGFDIWGQGTMVTVSS

SEQ ID NO: 1143 - protein, 16 aa, Artificial Sequence
  Synthetic
AAPYCSNGVCHDGFDI

SEQ ID NO: 1144 - protein, 108 aa, Artificial Sequence
  Synthetic
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPWTFGQGTKVEIK

SEQ ID NO: 1145 - protein, 9 aa, Artificial Sequence
  Synthetic
QQYGSSPWT

SEQ ID NO: 1146 - protein, 127 aa, Artificial Sequence
  Synthetic
EVQLVESGGGLVKPGRSLRLSCTASGFTFGDYAMSWFRQAPGKGLEWVGFIRSKAFGGTTEYAASVKGRFTISRDDSKSIAYLQMNSLKTEDTAVYYCTRRIMYYSDSSGSRTFDYWGQGTLVTVSS

SEQ ID NO: 1147 - protein, 18 aa, Artificial Sequence
  Synthetic
TRRIMYYSDSSGSRTFDY

SEQ ID NO: 1148 - protein, 106 aa, Artificial Sequence
  Synthetic
EIVMTQSPATLSVSPGERATLSCRASQSVNSNLAWYQQKPGQAPRLLIYGASTRATGIPARFSGSGSGTEFTLTISSLQSEDFAVYYCQQYNNWWTFGQGTKVEIK

SEQ ID NO: 1149 - protein, 8 aa, Artificial Sequence
  Synthetic
QQYNNWWT

SEQ ID NO: 1150 - protein, 121 aa, Artificial Sequence
  Synthetic
EVQLVESGGGLVKPGGSLRLSCAASGFTFSSYSMNWVRQAPGKGLECVSSISSSTSYIYYADSVKGRFTISRDNAKNSLYLQMNSLRAEDTAVYYCAREGMAGTDWYFDLWGRGTLVTVSS

SEQ ID NO: 1151 - protein, 14 aa, Artificial Sequence
  Synthetic
AREGMAGTDWYFDL

SEQ ID NO: 1152 - protein, 108 aa, Artificial Sequence
  Synthetic
DIQMTQSPSSLSASVGDRVTITCRASQTISSYLNWYQQKPGKAPKLLIYAASSLQSGVPSRFSGSGSGTDFTLTISSLQPEDFATYYCQQSYSTPPPTFGGGTKVEIK

SEQ ID NO: 1153 - protein, 10 aa, Artificial Sequence
  Synthetic
QQSYSTPPPT

SEQ ID NO: 1154 - protein, 121 aa, Artificial Sequence
  Synthetic
EVQLVESGGGLIQPGGSLRLSCAASGFTVSSNYMSWVRQAPGKGLEWVSAMSGGGSTFYADSVKGRFTISRDNSKNTLYLQMNSLRAEDTAVYYCAREGAAANTWGWFDPWGQGTLVTVSS

SEQ ID NO: 1155 - protein, 15 aa, Artificial Sequence
  Synthetic
AREGAAANTWGWFDP

SEQ ID NO: 1156 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPRGCFGPGTKVDIK

SEQ ID NO: 1157 - protein, 10 aa, Artificial Sequence
  Synthetic
QQLNSYPRGC

SEQ ID NO: 1158 - protein, 127 aa, Artificial Sequence; identical to SEQ ID NO: 85
  Synthetic

SEQ ID NO: 1159 - protein, 18 aa, Artificial Sequence
  Synthetic
TRRIMYYSDNSGSRTFDY

SEQ ID NO: 1160 - protein, 105 aa, Artificial Sequence
  Synthetic
EIVMTQSPVLSVSPGESVTLSCRASQSVSSNLAWYQQKPGQAPRLLIYGAAIRATGIPARFSGSGSGTEFTLTISSLQSEDFALYYCQQYNNWWTFGQGTKVEIK

SEQ ID NO: 1161 - protein, 8 aa, Artificial Sequence
  Synthetic
QQYNNWWT

SEQ ID NO: 1162 - protein, 123 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNILYLQMHSLRAEDTAVYYCAKYLMVYASPRNYFDYWGQGTLVTVSS

SEQ ID NO: 1163 - protein, 16 aa, Artificial Sequence
  Synthetic
AKYLMVYASPRNYFDY

SEQ ID NO: 1164 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGPGTKVDIK

SEQ ID NO: 1165 - protein, 9 aa, Artificial Sequence
  Synthetic
QQYDNLPLT

SEQ ID NO: 1166 - protein, 126 aa, Artificial Sequence
  Synthetic
QVQLQESGPGLVKPSGTLSLTCAVSGGSISSNFWWSWVRQPPGKGLEWIGEIYHSGSTNYNPSLKSRVTISIDKSKNQFSLNLSSVTAADTAVYYCAREGPNRGGDLAAAGTSDYWGQGTLVTVSS

SEQ ID NO: 1167 - protein, 19 aa, Artificial Sequence
  Synthetic
AREGPNRGGDLAAAGTSDY

SEQ ID NO: 1168 - protein, 109 aa, Artificial Sequence
  Synthetic
EIVMTQSPATLSVSPGERATLSCRASQSVSSNLAWYQHKPGQAPRLLIFGASTRATGIPARFSGSGSGTEFTLTISSLQSEDFAVYYCQQYNDWPPMYTFGQGTKLEIK

SEQ ID NO: 1169 - protein, 11 aa, Artificial Sequence
  Synthetic
QQYNDWPPMYT

SEQ ID NO: 1170 - protein, 117 aa, Artificial Sequence; identical to SEQ ID NO: 113
  Synthetic

SEQ ID NO: 1171 - protein, 11 aa, Artificial Sequence
  Synthetic
ARDWGDNYFDY

SEQ ID NO: 1172 - protein, 108 aa, Artificial Sequence
  Synthetic
EIVLTQSPGTLSLSPGERATLSCRASQSLSSRFLAWYQQKPGQAPRLLIYDASSRATGIPDRFRGSGSETDFTLTISRLEPEDFAVYYCQQYGSSPRTFGQGTKVEVK

SEQ ID NO: 1173 - protein, 9 aa, Artificial Sequence
  Synthetic
QQYGSSPRT

SEQ ID NO: 1174 - protein, 122 aa, Artificial Sequence
  Synthetic
EVQLVQSGAEVKKPGESLRISCKGSGYSFTSYWISWVRQMPGKGLEWMGRIDPSDSYSDYSPSFQGHVTISADKSISTAYLQWSSLKASDTAMYYCARHADEYSRWGWFDPWGQGTLVTVSS

SEQ ID NO: 1175 - protein, 15 aa, Artificial Sequence
  Synthetic
ARHADEYSRWGWFDP

SEQ ID NO: 1176 - protein, 109 aa, Artificial Sequence
  Synthetic
EIVLTQSPGTLSLSPGERATLSCRASQSVSSSYLAWSQQKPGQAPRLLIYGASSRATGIPDRFSGSGSGTDFTLTISRLEPEDFAVYYCQQYGGSPGYTFGQGTKLEIK

SEQ ID NO: 1177 - protein, 10 aa, Artificial Sequence
  Synthetic
QQYGGSPGYT

SEQ ID NO: 1178 - protein, 128 aa, Artificial Sequence
  Synthetic
EVQLVESGGLVKPGGSLRLSCAASGFTFSRYSMNWVRQAPGKGLEWVSSISSNSSYIYYADSLKGRFTISRDNAKNSLYLQMNSLRAEDTAVFYCTSEPTPYYFDNSAYYGAEYFQHWGQGTLVTVSS

SEQ ID NO: 1179 - protein, 22 aa, Artificial Sequence
  Synthetic
TSEPTPYYFDNSAYYGAEYFQH

SEQ ID NO: 1180 - protein, 107 aa, Artificial Sequence
  Synthetic
DIQMTQSPSTLSASVGDRVTITCRASQTISRWLAWYQQKPGKAPKLLIYMTSSLESGVPSRFSGSGSGTEFTLTISSLQPDDFATYYCQQYNSYSRTFGQGTKVEIK

SEQ ID NO: 1181 - protein, 9 aa, Artificial Sequence
  Synthetic
QQYNSYSRT

SEQ ID NO: 1182 - protein, 121 aa, Artificial Sequence
  Synthetic
EVQLVESGGVLVQPGRSLRLSCAASGFTFSNYDMHWVRQLTGKGLEWVSTIGTAGDTYYLGSVKGRFTISREDAKNSLYLQMNSLRAEDTAVYYCARVDSSVTPPLYFDYWGQGTLVTVSS

SEQ ID NO: 1183 - protein, 15 aa, Artificial Sequence
  Synthetic
ARVDSSVTPPLYFDY

SEQ ID NO: 1184 - protein, 108 aa, Artificial Sequence
  Synthetic
DIQMTQSPSSVSASVGDRVTITCRASQGISSWLAWYQQKPGKAPKLLIYGASSLQSGVPSRFSGSGFGTDFTLTISSLQPEDFATYYCQQAYSFPPLTFGGGTKVEIK

SEQ ID NO: 1185 - protein, 10 aa, Artificial Sequence
  Synthetic
QQAYSFPPLT

SEQ ID NO: 1186 - protein, 122 aa, Artificial Sequence
  Synthetic
EVQLVQSGAEVKKPGESLRISCKGSGYSFTNYWISWVRQMPGKGLEWMGKIDPGDSFTNYSPSFQGHVTISVDKSITTAYLQWSSLKASDTAIYYCARQKGYFQQLAPFDYWGQGTLVTVSS

SEQ ID NO: 1187 - protein, 15 aa, Artificial Sequence
  Synthetic
ARQKGYFQQLAPFDY

SEQ ID NO: 1188 - protein, 108 aa, Artificial Sequence
  Synthetic
DIQMTQSPSTLSAPVGDRVTITCRASQSLSSWLAWYQQKPGKAPKLLIYQASSLESGVPSRISGSGSATEFTLTISSLQPDDSGTYFCQQYKSYSEYTFGQGTKLEIK

SEQ ID NO: 1189 - protein, 10 aa, Artificial Sequence
  Synthetic
QQYKSYSEYT

SEQ ID NO: 1190 - protein, 120 aa, Artificial Sequence
  Synthetic
EVQLVQSGAEVKKPGESLRISCKGSGYIFTTFWISWVRQMPGKGLEWMGRIDPSDSYTNYSPSFQGHVTISADKTISTAYLQWSNLKASDTAFYYCARHVCGRDCYLDYWGQGTLVTVSS

SEQ ID NO: 1191 - protein, 13 aa, Artificial Sequence
  Synthetic
ARHVCGRDCYLDY

SEQ ID NO: 1192 - protein, 107 aa, Artificial Sequence
  Synthetic
DIQMTQSPSSLSASVGDRVTITCHASQDISNFLNWYQQKPGKAPKLLIYDASNLETGVPSRFSGSGSGTDFTFTISSLQPEDIATYYCQQYNHLPITFGQGTRLEIK

SEQ ID NO: 1193 - protein, 9 aa, Artificial Sequence
  Synthetic
QQYNHLPIT

SEQ ID NO: 1194 - protein, 126 aa, Artificial Sequence; identical to SEQ ID NO: 79
  Synthetic

SEQ ID NO: 1195 - protein, 19 aa, Artificial Sequence
  Synthetic
AKVTFRTELTQVVPNYFDF

SEQ ID NO: 1196 - protein, 107 aa, Artificial Sequence
  Synthetic
EIVLTQSPATLSLSPGERATLSCRASQSVNTYLAWYQQKPGQAPRLLIYDASNRATGIPARFSGSGSGTGFTLTISSLEPEDFAVYYCQQRTNWPLTFGGGTKVAIK

SEQ ID NO: 1197 - protein, 9 aa, Artificial Sequence
  Synthetic
QQRTNWPLT

SEQ ID NO: 1198 - protein, 115 aa, Artificial Sequence
  Synthetic
EVQLVESGGGLIQPGGSLRLSCAASGLTVSRNYMNWVRQAPGKGLEWVSVIYPGGSTFYADSVKGRFTISRDNSSNTLYLQMNSLRAEDTAVYYCAREAYGMDVWGQGTTVTVSS

SEQ ID NO: 1199 - protein, 9 aa, Artificial Sequence
  Synthetic
AREAYGMDV

SEQ ID NO: 1200 - protein, 108 aa, Artificial Sequence
  Synthetic
EIVLTQSPGTLSLSPGERATLSCRASQSVSSSYLAWYQQKPGQAPRLLIYGASSRATGIPDRFSGSGTGTDFTLSISRLEPEDFAVYYCQQYGSSPGTFGQGTKVEIK

SEQ ID NO: 1201 - protein, 9 aa, Artificial Sequence
  Synthetic
QQYGSSPGT

SEQ ID NO: 1202 - protein, 121 aa, Artificial Sequence; identical to SEQ ID NO: 103
  Synthetic

SEQ ID NO: 1203 - protein, 14 aa, Artificial Sequence
  Synthetic
VSDSPTTMVTIFDY

SEQ ID NO: 1204 - protein, 107 aa, Artificial Sequence; identical to SEQ ID NO: 104
  Synthetic

SEQ ID NO: 1205 - protein, 9 aa, Artificial Sequence
  Synthetic
QQSYSSLLT

SEQ ID NO: 1206 - protein, 121 aa, Artificial Sequence
  Synthetic
QVQLVESGGGVVQPGRSLRLSCAASGFTFSSYGMHWVRHAPDKGLEWVAVISSDGSIKYFADSVKGRFTISRDNSENTLYLQMNSLRAEDTAVYYCARDSNTVTTDLFDYWGQGTLVTVSS

SEQ ID NO: 1207 - protein, 14 aa, Artificial Sequence
  Synthetic
ARDSNTVTTDLFDY

SEQ ID NO: 1208 - protein, 106 aa, Artificial Sequence
  Synthetic
DIQMTQSPSSLSASVGDRVTITCRASQSISSYLNWYQQKPGKAPNLLIYAASNLQSGVPSRFSGSGSGTDFTLTISSLQPEDFATYYCHQSYSTSTFGQGTRLEIK

SEQ ID NO: 1209 - protein, 8 aa, Artificial Sequence
  Synthetic
HQSYSTST

SEQ ID NO: 1210 - protein, 121 aa, Artificial Sequence
  Synthetic
EVQLVESGGGLVQPGGSLRLSCSASGFTFSNYEMHWVRQGPGKGLEHVSAISSNGDITYYADSVKGRFTISRDNSKNTLWLQMNSLRTEDTAVYYCVKDLGKQPVADFGYWGQGTLVTVSS

SEQ ID NO: 1211 - protein, 14 aa, Artificial Sequence
  Synthetic
VKDLGKQPVADFGY

SEQ ID NO: 1212 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 1213 - protein, 9 aa, Artificial Sequence
  Synthetic
QQSYSTPYT

SEQ ID NO: 1214 - protein, 123 aa, Artificial Sequence
  Synthetic
QVQLVQSGAEVKKPGASVKVSCKASGYTFTSYYMHWVRQVPGQGLEWMGIINPSGGITSYAQKFQGRVTMTRDTSTSTVYMELSSLRSEDTAVYYCAREDSSGYTYVLGMDVWGQGTTVTVSS

SEQ ID NO: 1215 - protein, 16 aa, Artificial Sequence
  Synthetic
AREDSSGYTYVLGMDV

SEQ ID NO: 1216 - protein, 108 aa, Artificial Sequence
  Synthetic
DIQMTQSPSSLSASVGDRVTITCRASQSISSYLNWYQQKPGKAPKLLIYAASSLQSGVPSRFSGRGSGTDFTLTISSLQPEDFATYYCQQSYSTSALTFGGGTKVEIK

SEQ ID NO: 1217 - protein, 10 aa, Artificial Sequence
  Synthetic
QQSYSTSALT

SEQ ID NO: 1218 - protein, 123 aa, Artificial Sequence
  Synthetic
QVQLVESGGGVVQPGRSLRLSCAASGFTFSSFAMHWVRQAPGKGLEWVAVIWHDGSNKFLADSVKGRFTISRDNSKNTLFLQMNSLRAEDTAVYYCARDGFVDTVMVTWPDYWGRGTLVTVSS

SEQ ID NO: 1219 - protein, 16 aa, Artificial Sequence
  Synthetic
ARDGFVDTVMVTWPDY

SEQ ID NO: 1220 - protein, 108 aa, Artificial Sequence
  Synthetic
DIQMTQSPSSLSASVGDRVTITCRASQSISNYLNWYQQKPGKAPKLLIYAASSLQSGVPSRFSGSGSGTDFTLTISSLQPGDFATYYCQQSYNTPPWTFGQGTKLEIK

SEQ ID NO: 1221 - protein, 10 aa, Artificial Sequence
  Synthetic
QQSYNTPPWT

SEQ ID NO: 1222 - protein, 128 aa, Artificial Sequence
  Synthetic
EVQLVESGGGLIQPGGSLRLSCAASGFSVSNNYMSWIRQAPGKGLEWVSDIYSGGSVYYAISVKGRFSISRDNSQNTVYLQMNSLRAEDTAVYHCARDRRIEYSTSEGRYYRFGMDVWGQGTTVTVSS

SEQ ID NO: 1223 - protein, 22 aa, Artificial Sequence
  Synthetic
ARDRRIEYSTSEGRYYRFGMDV

SEQ ID NO: 1224 - protein, 107 aa, Artificial Sequence
  Synthetic
EIVLTQSPGTLSLSPGERATLSCRASQSVTSGYLAWYQQKPGQAPRLLIYGASSRAPGIPDRFIGSGSGTDFTLSISRLEPEDFAVYYCQLYGSSPLFGGGTKVEIK

SEQ ID NO: 1225 - protein, 8 aa, Artificial Sequence
  Synthetic
QLYGSSPL

SEQ ID NO: 1226 - protein, 124 aa, Artificial Sequence
  Synthetic
QVQLVQSGAEVKKPGASVKVSCKVSGYTLTELSMHWVRQAPGKGLEWMGGFDPEDGETIYAQKFQGRVTMTEDTSADTAYMELSSLRSEDTAVYYCATDKEQWLVDWSGAFDIWGQGTRVTVSS

SEQ ID NO: 1227 - protein, 17 aa, Artificial Sequence
  Synthetic
ATDKEQWLVDWSGAFDI

SEQ ID NO: 1228 - protein, 108 aa, Artificial Sequence
  Synthetic
EIVLTQSPGTLSLSPGERATLSCRASQSVSSTYLAWYQQKPGQAPRLLIYGALSRAAGIPDRFSGSGSGTDFTLTISRLEPEDLAVYYCQQYGSSPRTFGQGTKVEIK

SEQ ID NO: 1229 - protein, 9 aa, Artificial Sequence
  Synthetic
QQYGSSPRT

SEQ ID NO: 1230 - protein, 122 aa, Artificial Sequence
  Synthetic
EVQLVESGGGLVQPGGSLRLSCAASGFTFSSYDMHWVRQATGKGLEWVSVIGTAGDTYFLDSVKGRFTVSRENAKDSFYLHMNSLRAEDTAVYYCARADYDSNGHHNWFDTWGQGTRVTVSS

SEQ ID NO: 1231 - protein, 16 aa, Artificial Sequence
  Synthetic
ARADYDSNGHHNWFDT

SEQ ID NO: 1232 - protein, 108 aa, Artificial Sequence
  Synthetic
DIQMTQSPSSLSASVGDRVTITCRASLRIRTYLNWYQQKPGNAPKLLIYAASSLQSGVPSRFGGSGSGTDFTLTISSLQPEDFATYFCQQSYGTPPWTFGQGTKVEIK

SEQ ID NO: 1233 - protein, 10 aa, Artificial Sequence
  Synthetic
QQSYGTPPWT

SEQ ID NO: 1234 - protein, 127 aa, Artificial Sequence; identical to SEQ ID NO: 93
  Synthetic

SEQ ID NO: 1235 - protein, 20 aa, Artificial Sequence
  Synthetic
AKKSGLYCGGSSCHSGTFDY

SEQ ID NO: 1236 - protein, 107 aa, Artificial Sequence; identical to SEQ ID NO: 94
  Synthetic

SEQ ID NO: 1237 - protein, 9 aa, Artificial Sequence
  Synthetic
QQYDNLPLA

SEQ ID NO: 1238 - protein, 129 aa, Artificial Sequence; identical to SEQ ID NO: 97
  Synthetic

SEQ ID NO: 1239 - protein, 22 aa, Artificial Sequence
  Synthetic
ARELYYYDRSGYYGPDDYAFDI

SEQ ID NO: 1240 - protein, 107 aa, Artificial Sequence; identical to SEQ ID NO: 98
  Synthetic

SEQ ID NO: 1241 - protein, 9 aa, Artificial Sequence
  Synthetic
QHYNSYWRT

SEQ ID NO: 1242 - protein, 125 aa, Artificial Sequence
  Synthetic
QVQLVQSGAEVKKPGASVKVSCKASGYTFTSYGISWVRQAPGQGLEWVGWISTYNGDTNYAQKLQGRVTMTTDTSTSTAYLDLRSLRSDDTAVYYCARVMSAYCTGGSCYHFDYWGQGTLVTVSS

SEQ ID NO: 1243 - protein, 18 aa, Artificial Sequence
  Synthetic
ARVMSAYCTGGSCYHFDY

SEQ ID NO: 1244 - protein, 109 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYDNWPPLFTFGPGTKVDIK

SEQ ID NO: 1245 - protein, 11 aa, Artificial Sequence
  Synthetic
QQYDNWPPLFT

SEQ ID NO: 1246 - protein, 120 aa, Artificial Sequence
  Synthetic
QVQLVESGGGVVQPGRSLRLSCAVSGFTFSSYGMHWVRQAPGKGLEWVAVISNDGSYKSYADSVKGRFTISRDNSKNTLYLQMNSLRAEDTAVYFCATDEGEATTYPGYWGQGTLVTVSS

SEQ ID NO: 1247 - protein, 13 aa, Artificial Sequence
  Synthetic
ATDEGEATTYPGY

SEQ ID NO: 1248 - protein, 108 aa, Artificial Sequence
  Synthetic
DIQMTQSPSSLSASVGDRVTITCRASQSISSYLNWYQQKPGKAPKLLISATSSLQSGVPSRFSGSGSGTDFTLTISSLQPEDFATYYCLQNYNTPPWTFGQGTKVEIK

SEQ ID NO: 1249 - protein, 10 aa, Artificial Sequence
  Synthetic
LQNYNTPPWT

SEQ ID NO: 1250 - protein, 127 aa, Artificial Sequence
  Synthetic
QVQLVESGGGVVQPGRSLRLSCAASGFTFSHYGMHWVRQAPGKGLEWVAVMSYDGSNKYYADSVKGRFTISRDNSKNTLFLQMNSLRAEDTAVYYCAKLMGPYCSAYNCYSGAFDFWGQGTMVTVSS

SEQ ID NO: 1251 - protein, 20 aa, Artificial Sequence
  Synthetic
AKLMGPYCSAYNCYSGAFDF

SEQ ID NO: 1252 - protein, 106 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPFFGGGTKVEIK

SEQ ID NO: 1253 - protein, 8 aa, Artificial Sequence
  Synthetic
QQYDNLPF

SEQ ID NO: 1254 - protein, 121 aa, Artificial Sequence
  Synthetic
EVQLVESGGGLVQPGGSLRLSCAASGFTFSYYSMNWVRQAPGKGLEWVSYISSSSSTIYYADSVKGRFTISRDNAKNSLYLQMNSLRAEDTAVYYCARDYRDWNDILPDSWGQGTLVTVSS

SEQ ID NO: 1255 - protein, 14 aa, Artificial Sequence
  Synthetic
ARDYRDWNDILPDS

SEQ ID NO: 1256 - protein, 107 aa, Artificial Sequence
  Synthetic
DIQMTQSPSSLSASVGDRVTITCRASQSISSYLYWYQQKPGKAPKLLIYAASSLQSGVPSRFSGSGSGTDFTLTISNLQPEDFATYYCQQSYSTPLTFGQGTKVEIK

SEQ ID NO: 1257 - protein, 9 aa, Artificial Sequence
  Synthetic
QQSYSTPLT

SEQ ID NO: 1258 - protein, 123 aa, Artificial Sequence
  Synthetic
QVQLVESGGGVVQPGRSLRLSCAASGFPFSTYAMYWVRQAPGKGLEWVAVISLDGNNKYSADSVKGRFTISRDNFENTLYLQMNSLRTEDTAVYYCARGGVRGALGRGALDVWGQGTMVTVSS

SEQ ID NO: 1259 - protein, 16 aa, Artificial Sequence
  Synthetic
ARGGVRGALGRGALDV

SEQ ID NO: 1260 - protein, 112 aa, Artificial Sequence
  Synthetic
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQTLQTPYTFGQGTKLEIK

SEQ ID NO: 1261 - protein, 9 aa, Artificial Sequence
  Synthetic
MQTLQTPYT

SEQ ID NO: 1262 - protein, 121 aa, Artificial Sequence
  Synthetic
EVQLLESGGGLVQPGGSLRLSCAASGFTFSSYAMSWVRQAPGKGLEWVSGISGRGGITYYADSVKGRFTISRDNSKNTLYLQMNSLRAEDTAVYYCAKDIGYSSVTIDDFCGQGTLVTVSS

SEQ ID NO: 1263 - protein, 14 aa, Artificial Sequence
  Synthetic
AKDIGYSSVTIDDF

SEQ ID NO: 1264 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTIISLQPEDFATYYCQQSYSTPPTFGQGTKVEIK

SEQ ID NO: 1265 - protein, 9 aa, Artificial Sequence
  Synthetic
QQSYSTPPT

SEQ ID NO: 1266 - protein, 118 aa, Artificial Sequence; identical to SEQ ID NO: 101
  Synthetic

SEQ ID NO: 1267 - protein, 12 aa, Artificial Sequence
  Synthetic
ARDLGAAGALDF

SEQ ID NO: 1268 - protein, 108 aa, Artificial Sequence; identical to SEQ ID NO: 102
  Synthetic

SEQ ID NO: 1269 - protein, 9 aa, Artificial Sequence
  Synthetic
QQYGSSPDT

SEQ ID NO: 1270 - protein, 117 aa, Artificial Sequence
  Synthetic
EVQLVESGGGLIQPGGSLRLSCAASEFTVSSNYMSWVRQAPGKGLEWVSVIYSGGSTFYADSVKGRFTISRDSSKNTLYLQMNSLRAEDTAVYYCARDYGDWYFDYWGQGTLVTVSS

SEQ ID NO: 1271 - protein, 11 aa, Artificial Sequence
  Synthetic
ARDYGDWYFDY

SEQ ID NO: 1272 - protein, 107 aa, Artificial Sequence
  Synthetic
EIVLTQSPGTLSLSPGERATLSCRASQSVSSYLAWYQQKPGQAPRLLIYGASSRATGIPDRFSGSGSETDFTLTISRLEPEDFAVYYCQQYGSSPRTFGQGTKVEIK

SEQ ID NO: 1273 - protein, 9 aa, Artificial Sequence
  Synthetic
QQYGSSPRT

SEQ ID NO: 1274 - protein, 122 aa, Artificial Sequence
  Synthetic
QVQLQESGPGLVKPSGTLSLTCAVSGGSISSSDWWSWVRQPPGKGLEWIGEIHRSGSTDYNPSFKSRVTISVDKSNNQLSLKLSSVTAADTAVYYCARSSYLYDFWSGHHSWGQGTLVTVSS

SEQ ID NO: 1275 - protein, 15 aa, Artificial Sequence
  Synthetic
ARSSYLYDFWSGHHS

SEQ ID NO: 1276 - protein, 111 aa, Artificial Sequence
  Synthetic
DIVMTQSPLSLPVPGEPASISCRSSQSLLHSNGYNYLDWYLQKPGQSPQLLIYLGSNRASGVPDRFSGSGSGTDFTLKISRVEAEDVGVYYCMQALETPHTFGQGTKLEIK

SEQ ID NO: 1277 - protein, 9 aa, Artificial Sequence
  Synthetic
MQALETPHT

SEQ ID NO: 1278 - protein, 120 aa, Artificial Sequence
  Synthetic
QLQLQESGPGLVKPSETLSLTCTVSGGSISSSSYYWGWIRQPPGKGLEWIGTIHYSGSTYYNPSLKSRVTVSVDTSKNHFSLKLSSVTAADTAVYYCARLWWLRGSFDYWGQGTLVTVSS

SEQ ID NO: 1279 - protein, 12 aa, Artificial Sequence
  Synthetic
ARLWWLRGSFDY

SEQ ID NO: 1280 - protein, 110 aa, Artificial Sequence; identical to SEQ ID NO: 106
  Synthetic

SEQ ID NO: 1281 - protein, 9 aa, Artificial Sequence
  Synthetic
QSYDSSNWV

SEQ ID NO: 1282 - protein, 118 aa, Artificial Sequence
  Synthetic
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCVHYYGSGDIDYWGQGTLVTVPS

SEQ ID NO: 1283 - protein, 11 aa, Artificial Sequence
  Synthetic
VHYYGSGDIDY

SEQ ID NO: 1284 - protein, 110 aa, Artificial Sequence; identical to SEQ ID NO: 110
  Synthetic

SEQ ID NO: 1285 - protein, 11 aa, Artificial Sequence
  Synthetic
AAWDDSLNGWV

SEQ ID NO: 1286 - protein, 131 aa, Artificial Sequence
  Synthetic
QVQLQESGPGLVKPSETLSLTCTVSGGSVSSGSYYWSWIRQAPGKGLEWIGYIYYSGSTNYNPSLKSRVTISVDTSKNQFSLKLSSVTAADTAVYYCARDRIGRYFDSSGYLPPYYGLDVWGQGTTVTVSS

SEQ ID NO: 1287 - protein, 23 aa, Artificial Sequence
  Synthetic
ARDRIGRYFDSSGYLPPYYGLDV

SEQ ID NO: 1288 - protein, 111 aa, Artificial Sequence
  Synthetic
QSVLTQPPSASGTPGQRVTISCSGSSSNIGSNYVYWYQQLPGTAPKLLIYSNNQRPSGVPDRFSGSKSGTSASLAISGLRSEDEADYYCAAWDDSLSGLYVFGTGTKVTVL

SEQ ID NO: 1289 - protein, 12 aa, Artificial Sequence
  Synthetic
AAWDDSLSGLYV

SEQ ID NO: 1290 - protein, 123 aa, Artificial Sequence; identical to SEQ ID NO: 129
  Synthetic

SEQ ID NO: 1291 - protein, 16 aa, Artificial Sequence
  Synthetic
ARGGSPIPAPGSDFDY

SEQ ID NO: 1292 - protein, 111 aa, Artificial Sequence
  Synthetic
QSVLTQPASVSGSPGQSITISCTGTSSDVGSYNLVSWYQQHPGKAPKLMIYEVSKRPSGVSNRFSGSKSGNTASLTISGLQAEDEADYYCCSYAGRSTFVVFGGGTKLTVL

SEQ ID NO: 1293 - protein, 11 aa, Artificial Sequence
  Synthetic
CSYAGRSTFVV

SEQ ID NO: 1294 - protein, 122 aa, Artificial Sequence
  Synthetic
QVQLQESGPGLVKPSQTLSLTCTVSGGSISSGDYYWNWIRQHPGKGLEWIGYIYYSGTTYYNPSLKSRVTISLDTSKNQFSLKLSSVTAADTAVYFCATGPPTVTTETFDYWGQGTLVTVSS

SEQ ID NO: 1295 - protein, 14 aa, Artificial Sequence
  Synthetic
ATGPPTVTTETFDY

SEQ ID NO: 1296 - protein, 110 aa, Artificial Sequence
  Synthetic
QSVLTQPPSVSAAPGQKVTISCSGSSSNIGNNYVSWYQHLPGTAPKLLIYDNNKRPSGIPDRFSGSKSGTSATLGITGLQTGDEADYYCGTWDSSSSAGVFGGGTKLTVL

SEQ ID NO: 1297 - protein, 11 aa, Artificial Sequence
  Synthetic
GTWDSSSSAGV

SEQ ID NO: 1298 - protein, 124 aa, Artificial Sequence
  Synthetic
EVQLVESGGGLIQPGGSLRLSCAASGFTVSTNYMSWVRQAPGKGLEWVSGIYSGGSAYYADSVKGRFTISRDNSKNTLHLQMNSLRAEDTADYYCARFIPPDSSGYSSGAFDIWGQGTMVTVSS

SEQ ID NO: 1299 - protein, 18 aa, Artificial Sequence
  Synthetic
ARFIPPDSSGYSSGAFDI

SEQ ID NO: 1300 - protein, 110 aa, Artificial Sequence
  Synthetic
QSVLTQPASVSGSPGQSITISCTGTSSDFGSYNLVSWYQQHPGKAPKLMIYEGSKRPSGVSNRFSGSKSGNTASLRISGLQAEDEADYYCCSYAGSSTWVFGGGTKLTVL

SEQ ID NO: 1301 - protein, 10 aa, Artificial Sequence
  Synthetic
CSYAGSSTWV

SEQ ID NO: 1302 - protein, 130 aa, Artificial Sequence
  Synthetic
QVQLVQSGAEVKKPGSSVKVSCKASGGTFSTYVFTWVRQAPGQGLEWMGGIIPIFGTANYAQKFKGRVTITADKSTTTAYMELSSLRSEDTAVYYCARANLDYDDVWGSYRYTGGAFDIWGQGTMVTVSS

SEQ ID NO: 1303 - protein, 23 aa, Artificial Sequence
  Synthetic
ARANLDYDDVWGSYRYTGGAFDI

SEQ ID NO: 1304 - protein, 110 aa, Artificial Sequence
  Synthetic
QSVLTQEPSFSVSPGGTVTLTCALSSGSVSTSYYPSWYQQTPGQAPRTLIYSTNTRSSGVPDRFSGSILGNKAALTITGAQADDESDYYCVLYMGSGISVFGGGTKLTVL

SEQ ID NO: 1305 - protein, 10 aa, Artificial Sequence
  Synthetic
VLYMGSGISV

SEQ ID NO: 1306 - protein, 120 aa, Artificial Sequence; identical to SEQ ID NO: 163
  Synthetic

SEQ ID NO: 1307 - protein, 13 aa, Artificial Sequence
  Synthetic
ARARLGQLLGFDY

SEQ ID NO: 1308 - protein, 110 aa, Artificial Sequence; identical to SEQ ID NO: 164
  Synthetic

SEQ ID NO: 1309 - protein, 9 aa, Artificial Sequence
  Synthetic
QSYDTSNWV

SEQ ID NO: 1310 - protein, 128 aa, Artificial Sequence
  Synthetic
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRPHYYDSSGYYWMTGIDYWGQGTLVTVSS

SEQ ID NO: 1311 - protein, 21 aa, Artificial Sequence
  Synthetic
ARDRPHYYDSSGYYWMTGIDY

SEQ ID NO: 1312 - protein, 110 aa, Artificial Sequence
  Synthetic
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNQVFGGGTKLTVL

SEQ ID NO: 1313 - protein, 9 aa, Artificial Sequence
  Synthetic
QSYDSSNQV

SEQ ID NO: 1314 - protein, 127 aa, Artificial Sequence
  Synthetic
EVQLVESGGGLVQPGRSLRLSCAASGFTFDDYAIHWVRQAPGKGLEWVAGMSWNSGTIGYADSVRGRFIISRDNAKNSLYLQMNRLRAEDTALYYCAKDKAGCSSTRCHESYGMDVWGQGTTVTVSS

SEQ ID NO: 1315 - protein, 20 aa, Artificial Sequence
  Synthetic
AKDKAGCSSTRCHESYGMDV

SEQ ID NO: 1316 - protein, 110 aa, Artificial Sequence
  Synthetic
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL

SEQ ID NO: 1317 - protein, 10 aa, Artificial Sequence
  Synthetic
SSYTSSSTVV

SEQ ID NO: 1318 - protein, 129 aa, Artificial Sequence
  Synthetic
QVQLVESGGGVVQPGRSLRLSCAASGFTFSNYGMHWVRQAPGKGLEWVAVMSYDGDNKYYADSVKGRFTISRDNSKNTLYLQVNSLRAEDTAVYYCAKAFRGAYSYGYPLSQYYGMDVWGQGTTVTVSS

SEQ ID NO: 1319 - protein, 22 aa, Artificial Sequence
  Synthetic
AKAFRGAYSYGYPLSQYYGMDV

SEQ ID NO: 1320 - protein, 109 aa, Artificial Sequence
  Synthetic
QSVLTQPPSVSAAPGQKVSISCSGSRSNIGNNYVSWYQLLPGTAPKLLIYDNNKRPSGIPDRFSGSKSGTSATLGITGLQTGDEADYYCGTWDSSLSWVFGGGTKVTVL

SEQ ID NO: 1321 - protein, 10 aa, Artificial Sequence
  Synthetic
GTWDSSLSWV

SEQ ID NO: 1322 - protein, 124 aa, Artificial Sequence
  Synthetic
EVQLVESGGGLIQPGGSLRLSCAASGFTVSSNYMSWVRQAPGKGLEWVSVIYSGDSTYYADSVKGRFTISRDNSKNTLYLQMNSLRAEDTAVYYCARLGGIAVAGTGDGAFDIWGQGTMVTVSS

SEQ ID NO: 1323 - protein, 18 aa, Artificial Sequence
  Synthetic
ARLGGIAVAGTGDGAFDI

SEQ ID NO: 1324 - protein, 110 aa, Artificial Sequence
  Synthetic
QSVLTQPASVSGSPGQSITISCTGTSSDVGSYNLVSWYQQHPGKAPKLMINEGSKRPSGVSNRFSGSKSGNTASLTISGLQAEDEADYYCCSYAGSSTWVFGGGTKLTVL

SEQ ID NO: 1325 - protein, 10 aa, Artificial Sequence
  Synthetic
CSYAGSSTWV

SEQ ID NO: 1326 - protein, 120 aa, Artificial Sequence
  Synthetic
QVQLVQSGAEVKKSGSSVKVSCKASGGTFSSYVISWVRQAPGQGLEWMGGILPIFGTANYAQKFQGRVTMTADESTSTAYMELSSLRSEDTAMYYCARSDSGSYAFFDYWGQGTLVTVSS

SEQ ID NO: 1327 - protein, 13 aa, Artificial Sequence
  Synthetic
ARSDSGSYAFFDY

SEQ ID NO: 1328 - protein, 110 aa, Artificial Sequence
  Synthetic
QTVVTQEPSFSVSPGGTVTLTCGLSSGSVSTSHYPSWYHQTPGQAPRTLIYNTNTRSSGVPDRFSGSILGNKAALTITGAQADDESDYYCVLYMGNGIWVFGGGTKLTVL

SEQ ID NO: 1329 - protein, 10 aa, Artificial Sequence
  Synthetic
VLYMGNGIWV

SEQ ID NO: 1330 - protein, 122 aa, Artificial Sequence
  Synthetic
QLQLQESGPGLVKPSETLSLTCTVSGGSISRSSYYWGWIRQPPGKGLEWIGSIYYSGSTYYNPSLKSRVTISVDTSKNQFSLKLSSVTAADTAVYYCARQGTWIEPYGMDVWGQGTTVTVSS

SEQ ID NO: 1331 - protein, 14 aa, Artificial Sequence
  Synthetic
ARQGTWIEPYGMDV

SEQ ID NO: 1332 - protein, 110 aa, Artificial Sequence
  Synthetic
QSVLTQEPSFSVSPGGTVTLTCGLSSGSVSTSYYPSWYQQTPGQAPRTLIYSTNTRSSGVPDRFSGSILGNKAALTITGAQADDESDYYCVLYMDSGLWVFGGGTKLTVL

SEQ ID NO: 1333 - protein, 10 aa, Artificial Sequence
  Synthetic
VLYMDSGLWV

SEQ ID NO: 1334 - protein, 128 aa, Artificial Sequence; identical to SEQ ID NO: 127
  Synthetic

SEQ ID NO: 1335 - protein, 21 aa, Artificial Sequence
  Synthetic
ARTLSYYDSSGTLLYEDYFDY

SEQ ID NO: 1336 - protein, 111 aa, Artificial Sequence; identical to SEQ ID NO: 128
  Synthetic

SEQ ID NO: 1337 - protein, 11 aa, Artificial Sequence
  Synthetic
QSYDSSLSGWV

SEQ ID NO: 1338 - protein, 123 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDPSGAVAGTNYFDYWGQGTLVTVSS

SEQ ID NO: 1339 - protein, 16 aa, Artificial Sequence
  Synthetic
AKDPSGAVAGTNYFDY

SEQ ID NO: 1340 - protein, 109 aa, Artificial Sequence
  Synthetic
SYVLTQPPSVSVAPGKTARITCGGNNIGSKSVHWYQQKPGQAPVLVVYDDSDRPSGIPERFSGSNSGNTATLTISRVEAGDEADYYCQVWDSSSDHFWVFGGGTKLTVL

SEQ ID NO: 1341 - protein, 12 aa, Artificial Sequence
  Synthetic
QVWDSSSDHFWV

SEQ ID NO: 1342 - protein, 132 aa, Artificial Sequence
  Synthetic
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDRYPRLYYDSSAYYYNYYFDYWGQGTLVTVSS

SEQ ID NO: 1343 - protein, 23 aa, Artificial Sequence
  Synthetic
TTDRYPRLYYDSSAYYYNYYFDY

SEQ ID NO: 1344 - protein, 110 aa, Artificial Sequence
  Synthetic
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSNNQVFGGGTKLTVL

SEQ ID NO: 1345 - protein, 9 aa, Artificial Sequence
  Synthetic
QSYDSNNQV

SEQ ID NO: 1346 - protein, 128 aa, Artificial Sequence; identical to SEQ ID NO: 127
  Synthetic

SEQ ID NO: 1347 - protein, 21 aa, Artificial Sequence
  Synthetic
ARTLSYYDSSGTLLYEDYFDY

SEQ ID NO: 1348 - protein, 111 aa, Artificial Sequence; identical to SEQ ID NO: 128
  Synthetic

SEQ ID NO: 1349 - protein, 11 aa, Artificial Sequence
  Synthetic
QSYDSSLSGWV

SEQ ID NO: 1350 - protein, 118 aa, Artificial Sequence
  Synthetic
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARRLPYGDYEDYWGQGTLVTVSS

SEQ ID NO: 1351 - protein, 12 aa, Artificial Sequence
  Synthetic
ARRLPYGDYEDY

SEQ ID NO: 1352 - protein, 109 aa, Artificial Sequence
  Synthetic
QSVLTQPPSVSGAPGQRVTISCTGSSSNIGTGYDVHWYQQLPGTAPKLLIYGNSNRPSGVPDRFSGSKGTSASLAIGLQAEDEGDYYCQSYDSSLSGSVFGGGTKLTVL

SEQ ID NO: 1353 - protein, 11 aa, Artificial Sequence
  Synthetic
QSYDSSLSGSV

SEQ ID NO: 1354 - protein, 121 aa, Artificial Sequence
  Synthetic
EVQLVQSGAEVKKPGESLKISCKASGYSFTSYWIGWVRQMPGKGLEWMGIIYPGDSDTRYSPSFQGQVTISADKSISTAYLQWSSLKASDTAMYYCARQGSSGSYDAFDIWGQGTMVTVSS

SEQ ID NO: 1355 - protein, 14 aa, Artificial Sequence
  Synthetic
ARQGSSGSYDAFDI

SEQ ID NO: 1356 - protein, 110 aa, Artificial Sequence
  Synthetic
QSVLTQPPSASGTPGQRVTISCSGSSSNIGSNTVNWYQQLPGTAPKLLIYVNNQRPSGVPDRFSGSKSGTSASLAISGLQSEDEADYYCAAWDDSLNAYVFATGTKVTVL

SEQ ID NO: 1357 - protein, 11 aa, Artificial Sequence
  Synthetic
AAWDDSLNAYV

SEQ ID NO: 1358 - protein, 124 aa, Artificial Sequence
  Synthetic
EVQLVQSGAEVKKPGESLKISCKASGYTFTNYWIAWVRQMPGKGLEWMGIIYPGDSDTRYSPSFQGQVTISADKSISTAYLQWSSLKASDTAMYYCATRCTGYYFTCSSAFDIWGKGTMVTVSS

SEQ ID NO: 1359 - protein, 17 aa, Artificial Sequence
  Synthetic
ATRCTGYYFTCSSAFDI

SEQ ID NO: 1360 - protein, 108 aa, Artificial Sequence
  Synthetic
SYVLTQPPSVSVAPGKTARITCGGNNIGSKTVHWYQQKPGQAPVLVVYDDSDRPSGIPERFSGSNSGNTATLTISRVEAGDEADYYCQVWDSSSDHPVFGGGTKLTVL

SEQ ID NO: 1361 - protein, 11 aa, Artificial Sequence
  Synthetic
QVWDSSSDHPV

SEQ ID NO: 1362 - protein, 132 aa, Artificial Sequence
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAEYYCAKDWSAYYYDRSGYLRLDYYYGMDVWGQGTTVTVSS

SEQ ID NO: 1363 - protein, 25 aa, Artificial Sequence
  Synthetic
AKDWSAYYYDRSGYLRLDYYYGMDV

SEQ ID NO: 1364 - protein, 110 aa, Artificial Sequence
  Synthetic
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNRVVFGGGTKLTVL

SEQ ID NO: 1365 - protein, 10 aa, Artificial Sequence
  Synthetic
SSYAGSNRVV

SEQ ID NO: 1366 - protein, 129 aa, Artificial Sequence
  Synthetic
QVQLVESGGGVVQPGRSLRLSCAASGFTFSRYDMHWVRQAPGKGLEWVALIWYDGSNKYYADSVKGRFTISRDNSKNTLYLQMNGLRAEDTAVYYCARPELGYFDRSGYYREGEFFDYWGQGTLVTVSS

SEQ ID NO: 1367 - protein, 22 aa, Artificial Sequence
  Synthetic
ARPELGYFDRSGYYREGEFFDY

SEQ ID NO: 1368 - protein, 112 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFVVFGGGTKLTVL

SEQ ID NO: 1369 - protein, 12 aa, Artificial Sequence
  Synthetic
QSYDSSLSGFVV

SEQ ID NO: 1370 - protein, 128 aa, Artificial Sequence
  Synthetic
QVQLVESGGGVVQPGRSLRLSCAASGFTFSSYAMHWVRQAPGKGLEWVAVISYDGSNKYYADSVKGRFTISRDNSKNTLYLQMNSLRPEDTAVYYCARGDSAEYCSGGSCYLGGPDYWGQGTLVTVSS

SEQ ID NO: 1371 - protein, 21 aa, Artificial Sequence
  Synthetic
ARGDSAEYCSGGSCYLGGPDY

SEQ ID NO: 1372 - protein, 109 aa, Artificial Sequence
  Synthetic
QSVLTQPPSASGTPGQRVTISCSGNSSNFRTNYVYWYQQLPGTAPKFLIYSNNQRPSGVPDRFSGSKSGTSASLAISGLRSEDEAEYYCAAWDDSLRWVFGGGTKLTVL

SEQ ID NO: 1373 - protein, 10 aa, Artificial Sequence
  Synthetic
AAWDDSLRWV

SEQ ID NO: 1374 - protein, 121 aa, Artificial Sequence
  Synthetic
EVQLLESGGGLIQPGGSLRLSCAASGVTFSSYAMSWVRQAPGKGLEWVSGISGIGDSTYYADSVKGRFTISRDNSKNTLYLQMNSLRAEDTAVYYCARIVVAAPGDYFDYWGQGTLVTVSS

SEQ ID NO: 1375 - protein, 14 aa, Artificial Sequence
  Synthetic
ARIVVAAPGDYFDY

SEQ ID NO: 1376 - protein, 110 aa, Artificial Sequence
  Synthetic
SYVLTQPPSVSVAPAKTARITCGGNNIGSKSVHWYQQKPGQAPVLVIYYDSDRPSGIPERFSGSNSGNTATLTISRVEAGDEADYYCQVWDGSSDHPGWVFGGGTKLTVL

SEQ ID NO: 1377 - protein, 13 aa, Artificial Sequence
  Synthetic
QVWDGSSDHPGWV

SEQ ID NO: 1378 - protein, 118 aa, Artificial Sequence
  Synthetic
EVQLVESGGGLIQPGGSLRLSCAASEFTVSSNYMSWVRQAPGKGLEWVSLIYSGGTTYYADSVKGRFTISRDNSKNTLYLQMNSLRAEDTAVYYCARCLPFGDYFDYWGQGTLVTVSS

SEQ ID NO: 1379 - protein, 12 aa, Artificial Sequence
  Synthetic
ARCLPFGDYFDY

SEQ ID NO: 1380 - protein, 110 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAWMFGGGTQLTVL

SEQ ID NO: 1381 - protein, 11 aa, Artificial Sequence
  Synthetic
GTWDSSLSAWM

SEQ ID NO: 1382 - protein, 121 aa, Artificial Sequence
  Synthetic
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASVLRFLEWPNTDYWGQGTLVTVSS

SEQ ID NO: 1383 - protein, 14 aa, Artificial Sequence
  Synthetic
ASVLRFLEWPNTDY

SEQ ID NO: 1384 - protein, 111 aa, Artificial Sequence
  Synthetic
QPVLTQSSSASASLGSSVKLTCTLSSGHSSYIIAWHQQQPGKAPRYLMKFEGSGSYNKGSGVPDRFSGSSSGADRYLTISNLQSEDEADYYCETWDSNFWVFGGGTKLTVL

SEQ ID NO: 1385 - protein, 9 aa, Artificial Sequence
  Synthetic
ETWDSNFWV

SEQ ID NO: 1386 - protein, 121 aa, Artificial Sequence
  Synthetic
QVQLQESGPGLVKPSQTLSLTCTVSGGSISSGDYYWSWIRQPPGKGLEWIGYIFYSGITYYNPSLKSRVTISVDTSKNQFALKLSSVTAADTAVYYCARVSRRWLHPFDYWGQGTLVTVSS

SEQ ID NO: 1387 - protein, 13 aa, Artificial Sequence
  Synthetic
ARVSRRWLHPFDY

SEQ ID NO: 1388 - protein, 110 aa, Artificial Sequence
  Synthetic
QSVLTQPPSASGSPGQSVTIPCTGTSSDVGGYNYVSWYQQHPGKAPKLMIYEVSKRPSGVPDRFSGSKSGNTASLTVSGLQAEDEADYYCSSYAGSNNPVFGGGTKLTVL

SEQ ID NO: 1389 - protein, 10 aa, Artificial Sequence
  Synthetic
SSYAGSNNPV

SEQ ID NO: 1390 - protein, 120 aa, Artificial Sequence; identical to SEQ ID NO: 167
  Synthetic

SEQ ID NO: 1391 - protein, 13 aa, Artificial Sequence
  Synthetic
GRQVADAASGMDV

SEQ ID NO: 1392 - protein, 110 aa, Artificial Sequence; identical to SEQ ID NO: 168
  Synthetic

SEQ ID NO: 1393 - protein, 11 aa, Artificial Sequence
  Synthetic
AAWDDSLNGQV

SEQ ID NO: 1394 - protein, 128 aa, Artificial Sequence; identical to SEQ ID NO: 127
  Synthetic

SEQ ID NO: 1395 - protein, 21 aa, Artificial Sequence
  Synthetic
ARTLSYYDSSGTLLYEDYFDY

SEQ ID NO: 1396 - protein, 111 aa, Artificial Sequence; identical to SEQ ID NO: 128
  Synthetic

SEQ ID NO: 1397 - protein, 11 aa, Artificial Sequence
  Synthetic
QSYDSSLSGWV

SEQ ID NO: 1398 - protein, 123 aa, Artificial Sequence
  Synthetic
QVQLVQSGAEVKKPGASVKVSCKASGYTFTSYYMHWVRQAPGQGLEWMGIINPSGESTSYAQKFQGRVTMTRDTSTSTVYMELSSLRSEDTAVYYCARGGSPIPAPGSDFDYWGQGTLVTVSS

SEQ ID NO: 1399 - protein, 16 aa, Artificial Sequence
  Synthetic
ARGGSPIPAPGSDFDY

SEQ ID NO: 1400 - protein, 111 aa, Artificial Sequence
  Synthetic
QSVLTQPASVSGSPGQSITISCTGTSSDVGSYNLVSWYQQHPGKAPKLMIYEVSKRPSGVSNRFSGSKSGNTASLTISGLQAEDEGDYYCCSYGGSSTFVIFGGGTKLTVL

SEQ ID NO: 1401 - protein, 11 aa, Artificial Sequence
  Synthetic
CSYGGSSTFVI

SEQ ID NO: 1402 - protein, 123 aa, Artificial Sequence
  Synthetic
EVQLVESGGGLVQPGGSLRLSCAASGFTFSNYWMSWVRQAPGKGLEWVANIKQDGSEKYHVDSVKGRFTISRDNAKNSLYLQMNSLRAEDTAVYYCAREGYRSGYVEGWFDPWGQGTLVTVSS

SEQ ID NO: 1403 - protein, 16 aa, Artificial Sequence
  Synthetic
AREGYRSGYVEGWFDP

SEQ ID NO: 1404 - protein, 108 aa, Artificial Sequence
  Synthetic
SYELTQPPSVSVSLGQMARITCSGEALPKKNAYWNQQKPGQFPVLVIYKDSERPSGIPERFSGSSSGTIVTLTISGVQAEDEADYYCLSADSSDTYKVFGGGTKLTVL

SEQ ID NO: 1405 - protein, 11 aa, Artificial Sequence
  Synthetic
LSADSSDTYKV

SEQ ID NO: 1406 - protein, 124 aa, Artificial Sequence
  Synthetic
EVQLVESGGGLIQPGGSLRLSCAASGFTVRSGYMSWVRQAPGKGLEWVSAIYSGSSTYYADSVKGRFTISRDNSKNTLYLQMNSLRAEDTAMYYCARFIPPDSRGYSSGAFDIWGQGTMITVSS

SEQ ID NO: 1407 - protein, 18 aa, Artificial Sequence
  Synthetic
ARFIPPDSRGYSSGAFDI

SEQ ID NO: 1408 - protein, 110 aa, Artificial Sequence
  Synthetic
QSVLTQPASVSGSPGQSITISCTGTSSDVGTYDLVSWYQQHPGKAPKLMIYEGSKRPSGVSNRFSGSKSGNTASLTISGLQAEDEADYYCCSYAGSSTWVFGGGTKLTVL

SEQ ID NO: 1409 - protein, 10 aa, Artificial Sequence
  Synthetic
CSYAGSSTWV

SEQ ID NO: 1410 - protein, 132 aa, Artificial Sequence
  Synthetic
EVQLLESGGGLVQPGGSLRLSCAASGFTFSSYAMSWVRQAPGKGLEWVSAISGSGGSTYYADSVKGRFTVSRDNSKNTLSLQMNSLRAEDTAIYYCAKALYDSSGYYLPGRSYYYYYAMDVWGQGTTVTVSS

SEQ ID NO: 1411 - protein, 25 aa, Artificial Sequence
  Synthetic
AKALYDSSGYYLPGRSYYYYYAMDV

SEQ ID NO: 1412 - protein, 113 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSNWVFGGGTKLTVL

SEQ ID NO: 1413 - protein, 13 aa, Artificial Sequence
  Synthetic
QSYDSSLSGSNWV

SEQ ID NO: 1414 - protein, 128 aa, Artificial Sequence
  Synthetic
QVQLVQSGAEVKKPGSSVKVSCTASGGTFSRHAISWVRKAPGQGLEWMGGIIPIFGLANYAQRFQGRVTIIADKSTSTAYMELSSLRSEDTAVYYCARALFYYDSSGSVRSEDYFDYWGQGTLVTVSS

SEQ ID NO: 1415 - protein, 21 aa, Artificial Sequence
  Synthetic
ARALFYYDSSGSVRSEDYFDY

SEQ ID NO: 1416 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPVFGGGTKLTVL

SEQ ID NO: 1417 - protein, 11 aa, Artificial Sequence
  Synthetic
QSYDSSLSGPV

SEQ ID NO: 1418 - protein, 115 aa, Artificial Sequence; identical to SEQ ID NO: 159
  Synthetic

SEQ ID NO: 1419 - protein, 9 aa, Artificial Sequence
  Synthetic
ARWARGFDP

SEQ ID NO: 1420 - protein, 93 aa, Artificial Sequence
  Synthetic
LRVWVSWTVDHHLLHWNQQRWWLLCLLVPTTPRQSPQTHDLCRYSALRDSLLWLQVQHGLPDHLWAPGGRGLLLQLIYKQHPGVRRRDQADRP

SEQ ID NO: 1421 - protein, 9 aa, Artificial Sequence
  Synthetic
SSYTSSIPV

SEQ ID NO: 1422 - protein, 121 aa, Artificial Sequence
  Synthetic
EVQLLESGGDLVQFGGSLRLSCAASGFTFSNYAMNWVRQAPGKGLEWVSAISGSGGSTYYADSVKGRFTISRDNSKNTLYLQMNSLRADDTAVYYCAKSRFSEDLEPFAYWGQGTLVTVSS

SEQ ID NO: 1423 - protein, 14 aa, Artificial Sequence
  Synthetic
AKSRFSEDLEPFAY

SEQ ID NO: 1424 - protein, 108 aa, Artificial Sequence
  Synthetic
SYVLTQPLSVSVALGQTARITCGGNNIGSINVHWYQQKPGQAPVLVIYRDSSRPSGIPERFSGSNSGNTATLTISRAQAGDEADYYCQVWDSSTGYVVFGGGTKLTVL

SEQ ID NO: 1425 - protein, 11 aa, Artificial Sequence
  Synthetic
QVWDSSTGYVV

SEQ ID NO: 1426 - protein, 120 aa, Artificial Sequence
  Synthetic
EVQLVESGGGLVQPGRSLRLSCAASGFTFDDYAMYWVRQTPGKGLEWVSGISWNSAGIGYADSVKGRFSISRDNAKNSVYLQMNIMRPEDTALYYCAKASSGYYTLIDYWGQGTLVTVSS

SEQ ID NO: 1427 - protein, 13 aa, Artificial Sequence
  Synthetic
AKASSGYYTLIDY

SEQ ID NO: 1428 - protein, 112 aa, Artificial Sequence
  Synthetic
QSVLTQSSSASASLGSSVKLTCTLSSGHSNYIIAWHQQQPGKAPRYLMKLEGSGSYNKGSGVPDRFSGSSSGADRYLTISNLQSEDEADYYCETWDSNTHKVFGGGTKLTVL

SEQ ID NO: 1429 - protein, 10 aa, Artificial Sequence
  Synthetic
ETWDSNTHKV

SEQ ID NO: 1430 - protein, 123 aa, Artificial Sequence; identical to SEQ ID NO: 153
  Synthetic

SEQ ID NO: 1431 - protein, 16 aa, Artificial Sequence
  Synthetic
AKERSWYYYDSSGSDY

SEQ ID NO: 1432 - protein, 112 aa, Artificial Sequence; identical to SEQ ID NO: 154
  Synthetic

SEQ ID NO: 1433 - protein, 11 aa, Artificial Sequence
  Synthetic
QSYDSSISSWV

SEQ ID NO: 1434 - protein, 124 aa, Artificial Sequence
  Synthetic
QVQLVESGGGVVQPGRSLRLSCAASGFTFSSYGMHWVRQAPGKGLEWVAVIWYDGSNKWYADSVKGRFTISRDNSKNTLYLQLNSLRAEDTAVYYCAKTGYSYGAAGRWYFDYWGQGTLVTVSS

SEQ ID NO: 1435 - protein, 17 aa, Artificial Sequence
  Synthetic
AKTGYSYGAAGRWYFDY

SEQ ID NO: 1436 - protein, 110 aa, Artificial Sequence
  Synthetic
NFMLTQPHSVSESPGKTVIISCTRSSGSIASNYVQWYQQRPGSAPTTVIFEDNERPSGVPDRFSGSIDSSSNSASLTISGLKTEDEADYYCQSYDSSNVVFGGGTKLTVL

SEQ ID NO: 1437 - protein, 9 aa, Artificial Sequence
  Synthetic
QSYDSSNVV

SEQ ID NO: 1438 - protein, 121 aa, Artificial Sequence
  Synthetic
QVQLVQSGAEVKKPGSSVKVSCKASGGTFSSYAISWVRQAPGQGLEWMGGIIPIFGTANYAQKFQGRVTVTADESTGTAYMELSSLRSEDTAVYYCARELGHYGGSHFDYWGQGTLVTVSS

SEQ ID NO: 1439 - protein, 14 aa, Artificial Sequence
  Synthetic
ARELGHYGGSHFDY

SEQ ID NO: 1440 - protein, 108 aa, Artificial Sequence
  Synthetic
SYVLTQPPSVSVAPGKTARITCGGNNIGSKNVHWYQQKPGQAPVLVVFDDSDRPSGIPERFSGSNSGNTATLTISRVEAGDEADYYCQVWDSSSDPWVFGGGTRLTVL

SEQ ID NO: 1441 - protein, 11 aa, Artificial Sequence
  Synthetic
QVWDSSSDPWV

SEQ ID NO: 1442 - protein, 135 aa, Artificial Sequence
  Synthetic
EVQLVESGGGLVQPGGSLRLSCAASGFTFSSYSMNWVRQAPGKGLEWVSYISSSSSTIYYADSVKGRFTVSRDNAKKSLYLQMNSLRDEDTAVYYCAREGYCSGGSCYEISVTTGVDYYYGMDVWGQGTTVTVSS

SEQ ID NO: 1443 - protein, 28 aa, Artificial Sequence
  Synthetic
AREGYCSGGSCYEISVTTGVDYYYGMDV

SEQ ID NO: 1444 - protein, 109 aa, Artificial Sequence
  Synthetic
QSVLTQPPSASGTPGQRVTISCSGSSSNIGSNTVSWYQQLPGTAPKLLIYNNNQRPSGVPDRFSGSKSGTSASLAISGLQSDDEADYYCAAWDDSLIRVFGTGTKVTVL

SEQ ID NO: 1445 - protein, 10 aa, Artificial Sequence
  Synthetic
AAWDDSLIRV

SEQ ID NO: 1446 - protein, 126 aa, Artificial Sequence
  Synthetic
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARVVRTVTMGRYYYGMDVWGQGTTVTVSS

SEQ ID NO: 1447 - protein, 18 aa, Artificial Sequence
  Synthetic
ARVVRTVTMGRYYYGMDV

SEQ ID NO: 1448 - protein, 109 aa, Artificial Sequence
  Synthetic
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYVGVGVLFGGGTKLTVL

SEQ ID NO: 1449 - protein, 9 aa, Artificial Sequence
  Synthetic
CSYVGVGVL

SEQ ID NO: 1450 - protein, 128 aa, Artificial Sequence
  Synthetic
EVQLVESGGGLVQPGGSLRLSCAASGFTFSRYWMHWVRQAPGKGLVWVSRINSDGSSTRYADSVKGRFTISRDSAKNTVYLQMNSLRAEDTAVYYCARTLYYYDRSGYGQSDDAFDIWGQGTMVTVSS

SEQ ID NO: 1451 - protein, 21 aa, Artificial Sequence
  Synthetic
ARTLYYYDRSGYGQSDDAFDI

SEQ ID NO: 1452 - protein, 113 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVVFGGGTKLTVL

SEQ ID NO: 1453 - protein, 13 aa, Artificial Sequence
  Synthetic
QSYDSSLSGSYVV

SEQ ID NO: 1454 - protein, 123 aa, Artificial Sequence
  Synthetic
EVQLVESGGGLVKPGGSLRLSCAASGFSFSNAWMSWVRQAPGKGLEWVGRIKSKTDDGTTDYAAPVKGRFTISRDDSKNTLYLQMNSLKTEDTAVYYCTTAMWTLTTGPFDYWGQGTLVTVSS

SEQ ID NO: 1455 - protein, 14 aa, Artificial Sequence
  Synthetic
TTAMWTLTTGPFDY

SEQ ID NO: 1456 - protein, 111 aa, Artificial Sequence
  Synthetic
QSVLTQPPSVSGAPGQRVTISCTGSSSNIGAGYDVHWYQQLPGTAPKFLIYGNSNRPSGVPDRFSGSRSGTSASLAITGLQAEDEADYYCQSYDSSLSGVVFGGGTKLTVL

SEQ ID NO: 1457 - protein, 11 aa, Artificial Sequence
  Synthetic
QSYDSSLSGVV

SEQ ID NO: 1458 - protein, 118 aa, Artificial Sequence; identical to SEQ ID NO: 165
  Synthetic

SEQ ID NO: 1459 - protein, 11 aa, Artificial Sequence
  Synthetic
ARRGSAWELDY

SEQ ID NO: 1460 - protein, 110 aa, Artificial Sequence; identical to SEQ ID NO: 166
  Synthetic

SEQ ID NO: 1461 - protein, 11 aa, Artificial Sequence
  Synthetic
AAWDDSLNGYV

SEQ ID NO: 1462 - protein, 123 aa, Artificial Sequence
  Synthetic
QVQLVQSGAEVKKPGSSVKVSCKASGGTFSSYAISWVRQAPGQGLEWMGGIIPLFGTANYAQKFQGRITITADKSTSTAYMELSSLRSEDTAVYFCARDRGDSGDFHGAFDIWGQGTMVTVSS

SEQ ID NO: 1463 - protein, 16 aa, Artificial Sequence
  Synthetic
ARDRGDSGDFHGAFDI

SEQ ID NO: 1464 - protein, 109 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSWVFGGGTKLTVL

SEQ ID NO: 1465 - protein, 10 aa, Artificial Sequence
  Synthetic
GTWDSSLSWV

SEQ ID NO: 1466 - protein, 117 aa, Artificial Sequence
  Synthetic
EVQLVESGGGLIQPGGSLRLSCAASGVTVSSNYMSWVRQAPGKGLEWVSVIYSGGSTYYADSVKGRFTISRDNSKNTLYIQMNSLRAEDTAVYYCARDLVVNAFDIWGQGTMVTVSS

SEQ ID NO: 1467 - protein, 11 aa, Artificial Sequence
  Synthetic
ARDLVVNAFDI

SEQ ID NO: 1468 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLTSYPPAFGQGTRLEIK

SEQ ID NO: 1469 - protein, 9 aa, Artificial Sequence
  Synthetic
QQLTSYPPA

SEQ ID NO: 1470 - protein, 127 aa, Artificial Sequence
  Synthetic
QVQLVQSGAEVKKPGSSVKVSCKASGGTFSSYAISWVRQAPGQGLEWMGGIIPIFDTANYAQKFQVRVTITADKSTSTTYMELSSLRSEDTAVYYCASGSWRHGYNEMVVHRGNFYWGQGTLVTVSS

SEQ ID NO: 1471 - protein, 20 aa, Artificial Sequence
  Synthetic
ASGSWRHGYNEMVVHRGNFY

SEQ ID NO: 1472 - protein, 112 aa, Artificial Sequence
  Synthetic
DIVMTQTPLSLSVTPGQSASISCKSSQSLLDSDGKTYLYWYLQKPGQPPQVLIYEVSNRFSGVPDRFSGSGSGTDFTLKISRVEAEDVGVYYCMQSIQPPYTFGQGTKLEIK

SEQ ID NO: 1473 - protein, 9 aa, Artificial Sequence
  Synthetic
MQSIQPPYT

SEQ ID NO: 1474 - protein, 124 aa, Artificial Sequence
  Synthetic
EVQLLESGGGLVQPGGSLRLSCAASGFTFSNYAMSWVRQAPGKGLEWVSAISSSGGSTYYADSVKGRFTISRDSSKNTLYLQMNSLRAEDTAVYYCAKDGGFWSAYSPSWFDPWGQGTLVTVSS

SEQ ID NO: 1475 - protein, 17 aa, Artificial Sequence
  Synthetic
AKDGGFWSAYSPSWFDP

SEQ ID NO: 1476 - protein, 108 aa, Artificial Sequence
  Synthetic
EIVLTQSPGTLSLSPGERATLSCRASQSIRGSYLAWYQQKPGQAPRLLIYGASSRATGIPDRFSGSGSGTDFTLTISRLEPEDFAVYYCQQYGSSPPTFGPGTKVDIK

SEQ ID NO: 1477 - protein, 9 aa, Artificial Sequence
  Synthetic
QQYGSSPPT

SEQ ID NO: 1478 - protein, 123 aa, Artificial Sequence
  Synthetic
QVQLVQSGAEVKKPGASVKVSCKASGYTFTNYYIHWVRQAPGQGLEWMGIINPSGGSTSYAQKFQGRVTMTGDTSTSTVYMELSSLRSEDTALYYCARAEGVVPVANRFFDYWGQGTLVTVSS

SEQ ID NO: 1479 - protein, 16 aa, Artificial Sequence
  Synthetic
ARAEGVVPVANRFFDY

SEQ ID NO: 1480 - protein, 113 aa, Artificial Sequence
  Synthetic
DIVMTQSPDSLTVSLGERATFNCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 1481 - protein, 9 aa, Artificial Sequence
  Synthetic
QQYYSTPLT

SEQ ID NO: 1482 - protein, 127 aa, Artificial Sequence; identical to SEQ ID NO: 135
  Synthetic

SEQ ID NO: 1483 - protein, 20 aa, Artificial Sequence
  Synthetic
ARGGRYCSGDSCYSNIWFDP

SEQ ID NO: 1484 - protein, 108 aa, Artificial Sequence; identical to SEQ ID NO: 136
  Synthetic

SEQ ID NO: 1485 - protein, 10 aa, Artificial Sequence
  Synthetic
QQLNSYPGIT

SEQ ID NO: 1486 - protein, 118 aa, Artificial Sequence
  Synthetic
EVQLVESGGGLIQPGGSLRLSCAASGVIVSSNYMTWVRQAPGKGLEWVSVIYSGGSTFYADSVKGRFTISRDNSKNTLYLQMNSLRVEDTAVYYCARDRSHHYGMDVWGQGTTVTVSS

SEQ ID NO: 1487 - protein, 12 aa, Artificial Sequence
  Synthetic
ARDRSHHYGMDV

SEQ ID NO: 1488 - protein, 108 aa, Artificial Sequence
  Synthetic
DIQLTQSPSFLSASVGDRVTITCRASQGISSYLAWYQLKPGKAPKLLIYAASTLQSGVPSRFSASGSGTEFTLTISSLQPEDFATYYCQQLNSYPPDTFGQGTKLEIK

SEQ ID NO: 1489 - protein, 10 aa, Artificial Sequence
  Synthetic
QQLNSYPPDT

SEQ ID NO: 1490 - protein, 124 aa, Artificial Sequence
  Synthetic
QVQLVESGGGVVQPGRSLRLSCAASGFTFSSYAIHWVRQAPGKGLEWVAIISYDGSKKYYADSVKGRFTISRDNSKNTLYLQMNSLRVEDTAMYYCARERTPGGWLQPDGMDVWGQGTTVTVSS

SEQ ID NO: 1491 - protein, 17 aa, Artificial Sequence
  Synthetic
ARERTPGGWLQPDGMDV

SEQ ID NO: 1492 - protein, 107 aa, Artificial Sequence
  Synthetic
DIQMTQSPSSLSASVGDRVSITCRASLSISSYLNWYQQKPGKAPKLLIYAASSLQSGVPSRFSGSGSGTDFTLTISSLQPEDFATYYCQQSYSPPHTFGQGTNLEIK

SEQ ID NO: 1493 - protein, 9 aa, Artificial Sequence
  Synthetic
QQSYSPPHT

SEQ ID NO: 1494 - protein, 123 aa, Artificial Sequence; identical to SEQ ID NO: 155
  Synthetic

SEQ ID NO: 1495 - protein, 16 aa, Artificial Sequence
  Synthetic
ARHQGSLSYYYHGMDV

SEQ ID NO: 1496 - protein, 107 aa, Artificial Sequence; identical to SEQ ID NO: 156
  Synthetic

SEQ ID NO: 1497 - protein, 9 aa, Artificial Sequence
  Synthetic
QQSYSTPST

SEQ ID NO: 1498 - protein, 127 aa, Artificial Sequence; identical to SEQ ID NO: 135
  Synthetic

SEQ ID NO: 1499 - protein, 20 aa, Artificial Sequence
  Synthetic
ARGGRYCSGDSCYSNIWFDP

SEQ ID NO: 1500 - protein, 108 aa, Artificial Sequence; identical to SEQ ID NO: 136
  Synthetic

SEQ ID NO: 1501 - protein, 10 aa, Artificial Sequence
  Synthetic
QQLNSYPGIT

SEQ ID NO: 1502 - protein, 128 aa, Artificial Sequence
  Synthetic
QVQLVQSGAEVKKPGSSVKVSCRASGGTFITYAISWVRQAPGQGLEWMGGIIPIVGTANYAQKVQGRVTITADKSTSTAYMELSSLRSEDTGVYYCAKGRRDGYHLKTYYYYYGMDVWGQGTTVTVSS

SEQ ID NO: 1503 - protein, 21 aa, Artificial Sequence
  Synthetic
AKGRRDGYHLKTYYYYYGMDV

SEQ ID NO: 1504 - protein, 112 aa, Artificial Sequence
  Synthetic
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPGTFGQGTKVEIK

SEQ ID NO: 1505 - protein, 9 aa, Artificial Sequence
  Synthetic
MQALQTPGT

SEQ ID NO: 1506 - protein, 133 aa, Artificial Sequence
  Synthetic
QVQLVQSGAEVKKPGASVKVSCKASGYTFTSYAISWVRQAPGQGLQWMGWISTYNGNTNYSQKLQGRVTMTTDTSTSTAYMELRSLRSDDTAVYFCAREACSSTSCPPSTLYDFWSGNGFDYWGQGTLVTVSS

SEQ ID NO: 1507 - protein, 26 aa, Artificial Sequence
  Synthetic
AREACSSTSCPPSTLYDFWSGNGFDY

SEQ ID NO: 1508 - protein, 112 aa, Artificial Sequence
  Synthetic
DIVMTQSPDSLAVSLGERATINCKSSQSVLYTSNNKNYLAWYQQKPGQPPKLLIYWASTRESGVPDRFSGSGSGTDFTLTISSLQAEDVAVYYCQQYYSTRTFGQGTKVEIK

SEQ ID NO: 1509 - protein, 8 aa, Artificial Sequence
  Synthetic
QQYYSTRT

SEQ ID NO: 1510 - protein, 119 aa, Artificial Sequence
  Synthetic
EVQLVESGGGLVQPGGSLRLSCSASGFTFSSYPMHWVRQAPGKGLEYVSAISSDGGSTYYVDSVKGRFTISRDNSKNTLYLQMSSLRTEDTAVYYCVKGDNYGLLLGYWGQGTLVTVSS

SEQ ID NO: 1511 - protein, 12 aa, Artificial Sequence
  Synthetic
VKGDNYGLLLGY

SEQ ID NO: 1512 - protein, 112 aa, Artificial Sequence
  Synthetic
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPLTFGGGTKVEIK

SEQ ID NO: 1513 - protein, 9 aa, Artificial Sequence
  Synthetic
MQATQFPLT

SEQ ID NO: 1514 - protein, 115 aa, Artificial Sequence
  Synthetic
EVQLVESGGGLIQPGGSLRLSCAASGLTVSSNYMTWVRQAPGKGLEWVSVLYSGGSTYYADSVKGRFIISRDNSKNTLYLQMNSLRAEDTAVYYCAREAYGMDVWGQGTTVTVSS

SEQ ID NO: 1515 - protein, 9 aa, Artificial Sequence
  Synthetic
AREAYGMDV

SEQ ID NO: 1516 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYRYTFGQGTKLEIK

SEQ ID NO: 1517 - protein, 9 aa, Artificial Sequence
  Synthetic
QQLNSYRYT

SEQ ID NO: 1518 - protein, 117 aa, Artificial Sequence; identical to SEQ ID NO: 143
  Synthetic

SEQ ID NO: 1519 - protein, 11 aa, Artificial Sequence
  Synthetic
ARGPYPAADNY

SEQ ID NO: 1520 - protein, 107 aa, Artificial Sequence; identical to SEQ ID NO: 118
  Synthetic

SEQ ID NO: 1521 - protein, 9 aa, Artificial Sequence
  Synthetic
QQYDNLPIT

SEQ ID NO: 1522 - protein, 127 aa, Artificial Sequence
  Synthetic
QVQLVESGGGVVQPGRSLRLSCAASGFTFRTYGMHWVRQAPGKGLEWVAVISYDGSNRYYADSVKGRITISRDNSKNTLYLQMSSLRAEDTAVYYCAKALGPYCGGGSCYSGPFDYWGQGTLVTVSS

SEQ ID NO: 1523 - protein, 20 aa, Artificial Sequence
  Synthetic
AKALGPYCGGGSCYSGPFDY

SEQ ID NO: 1524 - protein, 107 aa, Artificial Sequence
  Synthetic
DIQMTQSPSSLSASLGDRVTITCQASQDITNNLNWYQQKPGKAPNLLIFDASNLETGVPSRFSGSGSGTDFTFTISSLQPEDIATYYCQQYDNLPITFGQGTRLDIK

SEQ ID NO: 1525 - protein, 9 aa, Artificial Sequence
  Synthetic
QQYDNLPIT

SEQ ID NO: 1526 - protein, 126 aa, Artificial Sequence
  Synthetic
EVQLVESGGGLVQPGGSLRLSCAASGFTFSSYDMHWVRQATGKGLEWVSTIDTAGDPYYPGSVKGRFTISRENAKNSLYLQMNSLRAGDTAVYYCARERRYYDSSGYHRRDGMDVWGQGTTVTVSS

SEQ ID NO: 1527 - protein, 20 aa, Artificial Sequence
  Synthetic
ARERRYYDSSGYHRRDGMDV

SEQ ID NO: 1528 - protein, 108 aa, Artificial Sequence
  Synthetic
DIQMTQSPSSLSASVGDRVTITCQASQDISKYLNWYQQKPGKAPKLLIYDASNLETGVPSRFSGSGSGTDFTFTISSLQPEDIATYYCQQYDNFPPLTFGGGTKVEIK

SEQ ID NO: 1529 - protein, 10 aa, Artificial Sequence
  Synthetic
QQYDNFPPLT

SEQ ID NO: 1530 - protein, 117 aa, Artificial Sequence; identical to SEQ ID NO: 157
  Synthetic

SEQ ID NO: 1531 - protein, 11 aa, Artificial Sequence
  Synthetic
ARDYGDYYFDY

SEQ ID NO: 1532 - protein, 108 aa, Artificial Sequence; identical to SEQ ID NO: 158
  Synthetic

SEQ ID NO: 1533 - protein, 9 aa, Artificial Sequence
  Synthetic
QQYGSSPRT

SEQ ID NO: 1534 - protein, 128 aa, Artificial Sequence
  Synthetic
QVQLVQSGAEVKKPGSSVKVSCKASGGTFSSYAISWVRQAPGQGLEWMGGIIPIFGAAKYAQKFQGRVTITADESTSTAYMELSSLRSEDTAVYYCARDREVVVVVAGSPINYGMDVWGQGTTVTVSS

SEQ ID NO: 1535 - protein, 21 aa, Artificial Sequence
  Synthetic
ARDREVVVVVAGSPINYGMDV

SEQ ID NO: 1536 - protein, 107 aa, Artificial Sequence
  Synthetic
DIQMTQSPSTLSASVGDRVTITCRASQTISNWLAWYQQKPGKAPKLLIYKASTLDSGVPSRFSGSGSGTEFTLTISSLQPDDFATYYCQQYNTYSRTFGQGTKVEIK

SEQ ID NO: 1537 - protein, 9 aa, Artificial Sequence
  Synthetic
QQYNTYSRT

SEQ ID NO: 1538 - protein, 121 aa, Artificial Sequence
  Synthetic
QVQLVESGGGVVQPGRSLRLSCAASGFTFSSYSMHWVRQAPGKGLEWVAVISSDGSNKFYADSVKGRFTISRDNSKNTLYLQMNSLRAEDTAVFYCARDALTTMVTIFDYWGQGTLVTVSS

SEQ ID NO: 1539 - protein, 14 aa, Artificial Sequence
  Synthetic
ARDALTTMVTIFDY

SEQ ID NO: 1540 - protein, 108 aa, Artificial Sequence
  Synthetic
DIQMTQSPSSLSASVGDRVTITCRASQSISSYLNWYQQKPGKAPNLLIYDASSLQSGVPSRFSGSGSGTDFTLTISSLQPEDFATYYCQQSYSTLEITFGGGTKVEIK

SEQ ID NO: 1541 - protein, 10 aa, Artificial Sequence
  Synthetic
QQSYSTLEIT

SEQ ID NO: 1542 - protein, 127 aa, Artificial Sequence; identical to SEQ ID NO: 117
  Synthetic

SEQ ID NO: 1543 - protein, 20 aa, Artificial Sequence
  Synthetic
AKQISRYCGGGSCYSLTIDY

SEQ ID NO: 1544 - protein, 107 aa, Artificial Sequence; identical to SEQ ID NO: 118
  Synthetic

SEQ ID NO: 1545 - protein, 9 aa, Artificial Sequence
  Synthetic
QQYDNLPIT

SEQ ID NO: 1546 - protein, 130 aa, Artificial Sequence
  Synthetic
QVQLVQSGAEVKKPGSSVKVSCKASGGTFSSYAFSWVRQAPGQGLEWMGGIIPIFDTTNYAQKFQGRVTITADESTSTAYMELSSLRSEDTAVYFCARVRGTGATGLNKHIAAAGTFDNWGQGTLVTVSS

SEQ ID NO: 1547 - protein, 23 aa, Artificial Sequence
  Synthetic
ARVRGTGATGLNKHIAAAGTFDN

SEQ ID NO: 1548 - protein, 113 aa, Artificial Sequence
  Synthetic
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTQITFGQGTRLEIK

SEQ ID NO: 1549 - protein, 9 aa, Artificial Sequence
  Synthetic
QQYYSTQIT

SEQ ID NO: 1550 - protein, 125 aa, Artificial Sequence
  Synthetic
QVQLVQSGAEVKKPGASVKVSCKASGYTFTSYGISWVRQAPGQGLEWMGWINIYNGNTNYAQKFQGRVTMTTDTSTSTAYMELRSLRSDDTAVYYCARVQDYYGSRGTGYYFDYWGQGTLVTVSS

SEQ ID NO: 1551 - protein, 18 aa, Artificial Sequence
  Synthetic
ARVQDYYGSRGTGYYFDY

SEQ ID NO: 1552 - protein, 108 aa, Artificial Sequence
  Synthetic
EIVMTQSPATLSVSPGERATLSCRASQSISSDLAWYQQKPGQAPRLLIYGASTRATGIPARFSGSGSGTEFTLTISSLQSEDFAVYYCQQYDDWPPTWTFGQGTKVEI

SEQ ID NO: 1553 - protein, 11 aa, Artificial Sequence
  Synthetic
QQYDDWPPTWT

SEQ ID NO: 1554 - protein, 122 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKNVYSYGLTAYFDYWGQGTLVTVSS

SEQ ID NO: 1555 - protein, 15 aa, Artificial Sequence
  Synthetic
AKNVYSYGLTAYFDY

SEQ ID NO: 1556 - protein, 106 aa, Artificial Sequence
  Synthetic
DIQMTQSPSSLSASVGDRVTITCQASQDISNYLNWYQQKPGKAKLLIYDASNLETGVPSRFSGSGSGTDFTFTISSLQPEDIATYYCQQYDNLSFTFGGGTKVEIK

SEQ ID NO: 1557 - protein, 9 aa, Artificial Sequence
  Synthetic
QQYDNLSFT

SEQ ID NO: 1558 - protein, 124 aa, Artificial Sequence
  Synthetic
EVQLVESGGGLIQPGGSLRLSCAASGLTVSSNYMTWVRQAPGKGLEWVSLMYSGGTTDYADSVKGRFTISRDNSKNTLYLQMNSLRAEDTAVYYCARVGRALAATRSSLVFDYWGQGTLVTVSS

SEQ ID NO: 1559 - protein, 18 aa, Artificial Sequence
  Synthetic
ARVGRALAATRSSLVFDY

SEQ ID NO: 1560 - protein, 108 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPPFTFGPGTKVDIK

SEQ ID NO: 1561 - protein, 10 aa, Artificial Sequence
  Synthetic
QQYDNLPPFT

SEQ ID NO: 1562 - protein, 106 aa, Artificial Sequence
  Synthetic
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREDNRLTGT

SEQ ID NO: 1563 - skipped

SEQ ID NO: 1564 - protein, 108 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPPVTFGQGTKVEIK

SEQ ID NO: 1565 - protein, 10 aa, Artificial Sequence
  Synthetic
QQRSNWPPVT

SEQ ID NO: 1566 - protein, 127 aa, Artificial Sequence; identical to SEQ ID NO: 117
  Synthetic

SEQ ID NO: 1567 - protein, 20 aa, Artificial Sequence
  Synthetic
AKQISRYCGGGSCYSLTIDY

SEQ ID NO: 1568 - protein, 107 aa, Artificial Sequence; identical to SEQ ID NO: 118
  Synthetic

SEQ ID NO: 1569 - protein, 9 aa, Artificial Sequence
  Synthetic
QQYDNLPIT

SEQ ID NO: 1570 - protein, 118 aa, Artificial Sequence
  Synthetic
EVQLVQSGAEVKKPGESLRISCKASGNSFSFYWISWVRQMPGKGLEWMGRIDPSDSYSNYSPSFQGHVTISADKSISTAYLQWSSLKASDTAMYYCARHLSSGWFDYWGQGTLVTVSS

SEQ ID NO: 1571 - protein, 11 aa, Artificial Sequence
  Synthetic
ARHLSSGWFDY

SEQ ID NO: 1572 - protein, 106 aa, Artificial Sequence
  Synthetic
DIQMTQSPSLSASVGDRVTITCQASQDIRNFLNWYQQKPGKAPNLLIYDTSNLETGVPSRFSGSGSGTDFTFTISSLQPEDIATYYCQQYDNLPWTFGPGTKVEIK

SEQ ID NO: 1573 - protein, 9 aa, Artificial Sequence
  Synthetic
QQYDNLPWT

SEQ ID NO: 1574 - protein, 127 aa, Artificial Sequence
  Synthetic
QVQLVQSGAEVKKPGSSVKVSCKASGGTFSSYAINWVRQAPGQGLEWMAGIIPIFGTANYAQKFQGRVTITADESTSTAYMELSSLRSEDTAVYYCAARLAVTLKYTSGWNPEFDYWGQGTLVTVSS

SEQ ID NO: 1575 - protein, 20 aa, Artificial Sequence
  Synthetic
AARLAVTLKYTSGWNPEFDY

SEQ ID NO: 1576 - protein, 109 aa, Artificial Sequence
  Synthetic
EIVLTQSPATLSLSPGERATLSCRASQSVSSYLAWYQQKPGQAPRLLIYDASNRATGIPVRFSGSGSGTDFTLTISSLEPEDFAVYYCQQRSDWPPALTFGGGTKVEIK

SEQ ID NO: 1577 - protein, 11 aa, Artificial Sequence
  Synthetic
QQRSDWPPALT

SEQ ID NO: 1578 - protein, 122 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCLLGYSYGYSHGILPYWGQGTLVTVSS

SEQ ID NO: 1579 - protein, 15 aa, Artificial Sequence
  Synthetic
LLGYSYGYSHGILPY

SEQ ID NO: 1580 - protein, 107 aa, Artificial Sequence; identical to SEQ ID NO: 118
  Synthetic

SEQ ID NO: 1581 - protein, 9 aa, Artificial Sequence
  Synthetic
QQYDNLPIT

SEQ ID NO: 1582 - protein, 125 aa, Artificial Sequence
  Synthetic
QVQLVQSGAEVKKPGASVKVSCKASGYTFTSYGISWVRQAPGQGLEWMGWISTYNADTNYAQKLQGRVTMTTDTSTSTVYMELRSLRSDDTALYYCARVETYYSTSGSAYYFDYWGQGTLVTVSS

SEQ ID NO: 1583 - protein, 18 aa, Artificial Sequence
  Synthetic
ARVETYYSTSGSAYYFDY

SEQ ID NO: 1584 - protein, 109 aa, Artificial Sequence
  Synthetic
EIVMTQSPATLSVSPGERATLSCRASQSISNNLAWYQQKPGQAPRLLIYGASTRATGVPARFSGSGSGTEFTLTISSLQSEDFAVYYCQDYNNWPPTWTFGQGTKVEIK

SEQ ID NO: 1585 - protein, 11 aa, Artificial Sequence
  Synthetic
QDYNNWPPTWT

SEQ ID NO: 1586 - protein, 123 aa, Artificial Sequence
  Synthetic
QVQLVQSGAEVKKPGASVKVSCKASGYTFTSYDINWVRQATGQGLEWMGWMNPNSGNTGYAQKFQGRVTMTRNTSISTAYMELSSLRSEDTAVFYCARGGGYIPNHHDAFDMWGQGTMVTVSS

SEQ ID NO: 1587 - protein, 16 aa, Artificial Sequence
  Synthetic
ARGGGYIPNHHDAFDM

SEQ ID NO: 1588 - protein, 110 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPGYTFGQGTKLEIK

SEQ ID NO: 1589 - protein, 11 aa, Artificial Sequence
  Synthetic
QQYGSSPPGYT

SEQ ID NO: 1590 - protein, 128 aa, Artificial Sequence
  Synthetic
EVQLVQSGAEVKKPGESLRISCKGSGYNFTNYWISWVRQMPGKGLEWMGRIDPSDSYTNYSPSFQGHVTISADKSISTAYLQWSSLKASDTAMYYCARPFYDSSGYYSPYYYYGVDVWGQGTTVTVSS

SEQ ID NO: 1591 - protein, 21 aa, Artificial Sequence
  Synthetic
ARPFYDSSGYYSPYYYYGVDV

SEQ ID NO: 1592 - protein, 108 aa, Artificial Sequence
  Synthetic
EIVLTQSPGTLSLSPGERATLSCRASQSVNSIYLAWYQQKPGQAPRLLIYGASSRATGIPDRFSGSGSGTDFTLTISRLEPEDFAVYYCQQYGTSPRTFGQGTKVEIK

SEQ ID NO: 1593 - protein, 9 aa, Artificial Sequence
  Synthetic
QQYGTSPRT

SEQ ID NO: 1594 - protein, 120 aa, Artificial Sequence; identical to SEQ ID NO: 141
  Synthetic

SEQ ID NO: 1595 - protein, 13 aa, Artificial Sequence
  Synthetic
ARDYGDYVTYPDY

SEQ ID NO: 1596 - protein, 108 aa, Artificial Sequence; identical to SEQ ID NO: 142
  Synthetic

SEQ ID NO: 1597 - protein, 10 aa, Artificial Sequence
  Synthetic
QQSYSTPPWT

SEQ ID NO: 1598 - protein, 124 aa, Artificial Sequence
  Synthetic
QVQLVQSGAEVKKPGASVKVSCKASGYTFTSYGISWVRQAPGQGLEWMGWISTYNGNTNYAQKLQGRVTMTTDTSTSTAYMELRSLRSDDTAVYYCARVDTYYYDSSGYYFDYWGQGTLVTVSS

SEQ ID NO: 1599 - protein, 17 aa, Artificial Sequence
  Synthetic
ARVDTYYYDSSGYYFDY

SEQ ID NO: 1600 - protein, 109 aa, Artificial Sequence
  Synthetic
EIVMTQSPATLSVSPGERATLSCRASQSISSNLAWYHQKPGQAPRLLIYGASTRATGIPARFSGSGSGTEFTLTISSLQSEDFAVYYCQQYSNWPPQWTFGQGTKVEIK

SEQ ID NO: 1601 - protein, 11 aa, Artificial Sequence
  Synthetic
QQYSNWPPQWT

SEQ ID NO: 1602 - protein, 126 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKRNGAYCGGDCSLAYLDYWGQGTLVTVSS

SEQ ID NO: 1603 - protein, 19 aa, Artificial Sequence
  Synthetic
AKRNGAYCGGDCSLAYLDY

SEQ ID NO: 1604 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFIFTISSLQPEDIATYYCQQYDNLPITFGQGSRLEIK

SEQ ID NO: 1605 - protein, 9 aa, Artificial Sequence
  Synthetic
QQYDNLPIT

SEQ ID NO: 1606 - protein, 124 aa, Artificial Sequence; identical to SEQ ID NO: 123
  Synthetic

SEQ ID NO: 1607 - protein, 17 aa, Artificial Sequence
  Synthetic
ARVGTYYSDSSAYYFDY

SEQ ID NO: 1608 - protein, 109 aa, Artificial Sequence; identical to SEQ ID NO: 124
  Synthetic

SEQ ID NO: 1609 - protein, 11 aa, Artificial Sequence
  Synthetic
QQYDNWPPIFT

SEQ ID NO: 1610 - protein, 115 aa, Artificial Sequence
  Synthetic
EVQLVESGGGLIQPGGSLRLSCAASGFTVSSNYMSWVRQAPGKGLEWVSVIYSGGSTDYADSVKGRFTISRDNSKNTLYLQMNSLRAEDTAVYYCAREVYGMDVWGQGTTVTVSS

SEQ ID NO: 1611 - protein, 9 aa, Artificial Sequence
  Synthetic
AREVYGMDV

SEQ ID NO: 1612 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPPFGPGTKVDVK

SEQ ID NO: 1613 - protein, 9 aa, Artificial Sequence
  Synthetic
QQLNSYPPP

SEQ ID NO: 1614 - protein, 127 aa, Artificial Sequence; identical to SEQ ID NO: 139
  Synthetic

SEQ ID NO: 1615 - protein, 20 aa, Artificial Sequence
  Synthetic
AKQAELYCSAGSCYEGYIDY

SEQ ID NO: 1616 - protein, 108 aa, Artificial Sequence
  Synthetic
EIVLTQSPGTLSLSPGERATLSCRASQSVSNSYLAWYQQKPGQAPRLLISGASSRATGIPDRFSGSGSGTDFTLTISRLEPEDFAIYYCQQYGSSPGTFGQGTNVEIK

SEQ ID NO: 1617 - protein, 9 aa, Artificial Sequence
  Synthetic
QQYGSSPGT

SEQ ID NO: 1618 - protein, 126 aa, Artificial Sequence
  Synthetic
QVQLVESGGGLVKPGGSLRLSCAASGFTLSDYYMSWIRQAPGKGLEWVAYISISGTTIYYADSVKGRFTISRDNAKNSLDLQMNSLRAEDTAVYYCARDRLPGDSSGYTPPHFDYWGQGTLVTVSS

SEQ ID NO: 1619 - protein, 19 aa, Artificial Sequence
  Synthetic
ARDRLPGDSSGYTPPHFDY

SEQ ID NO: 1620 - protein, 107 aa, Artificial Sequence
  Synthetic
DIQMTQSPSSLSASVGDRVTITCRASQSISSYLNWYQQKPGKAPKLLIYSASHLQNGVPSRFSGSGSGPDFTLTISSLQPEDFATYYCQQSYSPPRTFGQGTKLEIK

SEQ ID NO: 1621 - protein, 9 aa, Artificial Sequence
  Synthetic
QQSYSPPRT

SEQ ID NO: 1622 - protein, 121 aa, Artificial Sequence; identical to SEQ ID NO: 133
  Synthetic

SEQ ID NO: 1623 - protein, 14 aa, Artificial Sequence
  Synthetic
ARGGGSSGYNWFDP

SEQ ID NO: 1624 - protein, 107 aa, Artificial Sequence; identical to SEQ ID NO: 134
  Synthetic

SEQ ID NO: 1625 - protein, 9 aa, Artificial Sequence
  Synthetic
QQSSSILYT

SEQ ID NO: 1626 - protein, 130 aa, Artificial Sequence; identical to SEQ ID NO: 131
  Synthetic

SEQ ID NO: 1627 - protein, 23 aa, Artificial Sequence
  Synthetic
ARVRGTAAAGPNEHIAAAGTFDY

SEQ ID NO: 1628 - protein, 113 aa, Artificial Sequence; identical to SEQ ID NO: 132
  Synthetic

SEQ ID NO: 1629 - protein, 9 aa, Artificial Sequence
  Synthetic
QQYYSTQIT

SEQ ID NO: 1630 - protein, 127 aa, Artificial Sequence
  Synthetic
EVQLVQSGAEVKKPGESLKISCKGSGYSFTRYWIGWVRQMPGKGLEWMGIIYPGDSDTRYSPSFQGQVTISADKSISTAYLQWTSLKASDTAMYYCARHISSSPGIAVTGTEELDYWGQGTLVTVSS

SEQ ID NO: 1631 - protein, 20 aa, Artificial Sequence
  Synthetic
ARHISSSPGIAVTGTEELDY

SEQ ID NO: 1632 - protein, 106 aa, Artificial Sequence
  Synthetic
DIQMTQSPSSVSASVGDRVTITCRASQGISSLLAWYQQKPGKAPKLLIYAASSLQSGVPSRFSGSGSGTDFTLTISSLQPEDFATYYCQQANSFPPTFGGGTKVEI

SEQ ID NO: 1633 - protein, 9 aa, Artificial Sequence
  Synthetic
QQANSFPPT

SEQ ID NO: 1634 - protein, 127 aa, Artificial Sequence
  Synthetic
QVQLVESGGGVVQPGRSLRLSCAASGFTFRSYGMHWVRQAPGKGLEWVAVIPYDGSNKYYAGSVKGRFTISRDNSKNTLYLQMNSLRAEDTAVYYCAKIAGSYCSGGNCYVGYFDYWGQGTLVTVSS

SEQ ID NO: 1635 - protein, 20 aa, Artificial Sequence
  Synthetic
AKIAGSYCSGGNCYVGYFDY

SEQ ID NO: 1636 - protein, 107 aa, Artificial Sequence
  Synthetic
DIQMTQSPSSLSASVGDRVTITCQASQDISNYLIWYQQKPGKAPKLLIYDASNLETGVPSRFSGSGSGTDFTFTISSLQPEDFAAYYCQQYDNLPLTFGGGTKVEIK

SEQ ID NO: 1637 - protein, 9 aa, Artificial Sequence
  Synthetic
QQYDNLPLT

SEQ ID NO: 1638 - protein, 117 aa, Artificial Sequence; identical to SEQ ID NO: 121
  Synthetic

SEQ ID NO: 1639 - protein, 11 aa, Artificial Sequence
  Synthetic
ARSLEAYGMDV

SEQ ID NO: 1640 - protein, 107 aa, Artificial Sequence; identical to SEQ ID NO: 122
  Synthetic

SEQ ID NO: 1641 - protein, 9 aa, Artificial Sequence
  Synthetic
QQLNSYGYT

SEQ ID NO: 1642 - protein, 121 aa, Artificial Sequence
  Synthetic
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGGGSSGYNWFDPWGQGTLVTVSS

SEQ ID NO: 1643 - protein, 14 aa, Artificial Sequence
  Synthetic
ARGGGSSGYNWFDP

SEQ ID NO: 1644 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTLYTFGQGTKLEIK

SEQ ID NO: 1645 - protein, 9 aa, Artificial Sequence
  Synthetic
QQSYSTLYT

SEQ ID NO: 1646 - protein, 123 aa, Artificial Sequence
  Synthetic
QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDVSVDTVMVSWFDPWGQGTLVTVSS

SEQ ID NO: 1647 - protein, 16 aa, Artificial Sequence
  Synthetic
ARDVSVDTVMVSWFDP

SEQ ID NO: 1648 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPSWTFGQGTKVEIK

SEQ ID NO: 1649 - protein, 10 aa, Artificial Sequence
  Synthetic
QQSYSTPSWT

SEQ ID NO: 1650 - protein, 121 aa, Artificial Sequence
  Synthetic
QVQLVESGGGVVQPGRSLRLSCAASGFTFSSYGMHWVRQAPGRGVEWVAVISYDASSKFYADSVKGRFTISRDNSKNTLYLQMNSLRAEDTAIYYCAKDRDDTHALILDYWGQGTLVTVSS

SEQ ID NO: 1651 - protein, 14 aa, Artificial Sequence
  Synthetic
AKDRDDTHALILDY

SEQ ID NO: 1652 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVEIK

SEQ ID NO: 1653 - protein, 10 aa, Artificial Sequence
  Synthetic
QQSYSTPPLT

SEQ ID NO: 1654 - protein, 120 aa, Artificial Sequence
  Synthetic
EVQLVESGGGLIQPGGSLRLSCAASGFTVSSNHMSWVRQAPGKGLEWVSVIYSGGSKYYADSVKGRFTISRDNSNNTLYLQMNSLRAEDTAVYYCAREPGYRYGYGVNYWGQGTLVTVSS

SEQ ID NO: 1655 - protein, 14 aa, Artificial Sequence
  Synthetic
AREPGYRYGYGVNY

SEQ ID NO: 1656 - protein, 106 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLLITFGQGTRQEI

SEQ ID NO: 1657 - protein, 9 aa, Artificial Sequence
  Synthetic
QQYDNLLIT

SEQ ID NO: 1658 - protein, 122 aa, Artificial Sequence
  Synthetic
QVQLVESGGGVVQPGRSLRLSCAASGFSFSSYALHWVRQAPGKGLEWVAVISNDGSNKYYTDSVKGRFTISRDNSKNTLYLEMNSLRAEDTAVYYCARDKVNTMIVDAFDIWGQGTMVTVSS

SEQ ID NO: 1659 - protein, 15 aa, Artificial Sequence
  Synthetic
ARDKVNTMIVDAFDI

SEQ ID NO: 1660 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTITSLQPEDFATYYCQQSYTSLMYTFGQGTKLEIK

SEQ ID NO: 1661 - protein, 10 aa, Artificial Sequence
  Synthetic
QQSYTSLMYT

SEQ ID NO: 1662 - protein, 121 aa, Artificial Sequence; identical to SEQ ID NO: 149
  Synthetic

SEQ ID NO: 1663 - protein, 14 aa, Artificial Sequence
  Synthetic
ARDHEMATIYGMDV

SEQ ID NO: 1664 - protein, 108 aa, Artificial Sequence; identical to SEQ ID NO: 150
  Synthetic

SEQ ID NO: 1665 - protein, 10 aa, Artificial Sequence
  Synthetic
QQSYSAPLLT

SEQ ID NO: 1666 - protein, 126 aa, Artificial Sequence; identical to SEQ ID NO: 151
  Synthetic

SEQ ID NO: 1667 - protein, 19 aa, Artificial Sequence
  Synthetic
AKGGYYYYGSGSYNYGFDY

SEQ ID NO: 1668 - protein, 107 aa, Artificial Sequence; identical to SEQ ID NO: 152
  Synthetic

SEQ ID NO: 1669 - protein, 9 aa, Artificial Sequence
  Synthetic
QQYDNLIFT

SEQ ID NO: 1670 - protein, 126 aa, Artificial Sequence
  Synthetic
EVQLVQSGAEVKKPGESLKISCKGSGYSFTSYWIGWVRQMPGKGLEWMGIIYPGDSDTRYSPSFEGQVTISADKSISTAYLQWSSLKASDTAMYYCARLSHNHYGSGSTGYHLDPWGQGTPVTVSS

SEQ ID NO: 1671 - protein, 19 aa, Artificial Sequence
  Synthetic
ARLSHNHYGSGSTGYHLDP

SEQ ID NO: 1672 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSLPPGTFGQGTKLEIK

SEQ ID NO: 1673 - protein, 10 aa, Artificial Sequence
  Synthetic
QQSYSLPPGT

SEQ ID NO: 1674 - protein, 122 aa, Artificial Sequence
  Synthetic
QVQLVQSGAEVKKPGASVKVSCKASGYTFTSYYIHWVRQAPGQGLEWMGIINPSAGSTSYAQRFQDRVTMTRDTSTSTVYMELSSLRSEDTAVYYCARDLVAVPAVSCLDHWGQGTLVTVSS

SEQ ID NO: 1675 - protein, 15 aa, Artificial Sequence
  Synthetic
ARDLVAVPAVSCLDH

SEQ ID NO: 1676 - protein, 109 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIK

SEQ ID NO: 1677 - protein, 11 aa, Artificial Sequence
  Synthetic
QQRSNWPPLFT

SEQ ID NO: 1678 - protein, 123 aa, Artificial Sequence
  Synthetic
EVQLVESGGGLVQPGGSLRLSCSTSGFTFSSYSMHWVRQAPGKGLEYVSGISTNGDITYYADSVKGRFTISRDNSKNTLYLQMSSLRAEDTAVYYCVKDVLSIEMATIVLDYWGQGTLVTVSS

SEQ ID NO: 1679 - protein, 16 aa, Artificial Sequence
  Synthetic
VKDVLSIEMATIVLDY

SEQ ID NO: 1680 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQLEDFATYSCQQSYSTPPTFGQGTKVEIK

SEQ ID NO: 1681 - protein, 9 aa, Artificial Sequence
  Synthetic
QQSYSTPPT

SEQ ID NO: 1682 - protein, 117 aa, Artificial Sequence
  Synthetic
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARANPIRSGDYWGQGTLVTVSS

SEQ ID NO: 1683 - protein, 11 aa, Artificial Sequence
  Synthetic
ARANPIRSGDY

SEQ ID NO: 1684 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPPTFGPGTKVDIK

SEQ ID NO: 1685 - protein, 9 aa, Artificial Sequence
  Synthetic
QQYDNLPPT

SEQ ID NO: 1686 - protein, 125 aa, Artificial Sequence
  Synthetic
QVQLQESGPGLVKPSQTLSLTCTVSGGSISSGDYYWSWIRQPPGKGLEWIGYIYYSGSTYYNPSLQSRVTISVDTSKNQFSLKLSSVTAADTAVYYCARDGCSGGSCYSYWFDPWGQGTLITVSS

SEQ ID NO: 1687 - protein, 17 aa, Artificial Sequence
  Synthetic
ARDGCSGGSCYSYWFDP

SEQ ID NO: 1688 - protein, 106 aa, Artificial Sequence; identical to SEQ ID NO: 146
  Synthetic

SEQ ID NO: 1689 - protein, 8 aa, Artificial Sequence
  Synthetic
QQRSSWST

SEQ ID NO: 1690 - protein, 115 aa, Artificial Sequence; identical to SEQ ID NO: 119
  Synthetic

SEQ ID NO: 1691 - protein, 9 aa, Artificial Sequence
  Synthetic
AREVYGMDV

SEQ ID NO: 1692 - protein, 107 aa, Artificial Sequence; identical to SEQ ID NO: 120
  Synthetic

SEQ ID NO: 1693 - protein, 9 aa, Artificial Sequence
  Synthetic
QQLNIYPPP

SEQ ID NO: 1694 - protein, 122 aa, Artificial Sequence
  Synthetic
EVQLVESGGVVVQPGGSLRLSCAASGFTFDDYSMHWVRQAPGKGLEWVSVFSWDGGRTYYADSVKGRFTISRDNNKNSLYLQMNSLRTEDTALYYCAKENSSGYYGNYFDLWGRGTLVTVSS

SEQ ID NO: 1695 - protein, 15 aa, Artificial Sequence
  Synthetic
AKENSSGYYGNYFDL

SEQ ID NO: 1696 - protein, 109 aa, Artificial Sequence
  Synthetic
DIQMTQSPSSLSASVGDRVTITCRASQSVSTYLNWYQQKPGKAPNLLIFAASSLQSGVPSRFSGSGSGTDFTLTISSLQPEDFATYYCQQSYSPSLMYTFGQGTKLEIK

SEQ ID NO: 1697 - protein, 11 aa, Artificial Sequence
  Synthetic
QQSYSPSLMYT

SEQ ID NO: 1698 - protein, 129 aa, Artificial Sequence
  Synthetic
QVQLQESGPGLVKPSETLSLTCTVSGGSISSYYWSWVRQPPGKGLEWIGYIYYSGSTNYNPSLKSRVTISVGTSMNQFSLKLSSVTAADTAVYYCARSRPGGYCSGGSCYSRPGVFDYWGQGTLVTVSS

SEQ ID NO: 1699 - protein, 23 aa, Artificial Sequence
  Synthetic
ARSRPGGYCSGGSCYSRPGVFDY

SEQ ID NO: 1700 - protein, 108 aa, Artificial Sequence
  Synthetic
EIVLTQSPGTLSLSPGESATLSCRASQSVSSDYLAWYQQKPGQAPRLLIYGASSRATGIPDRFRGSGSGTDFALTISGLEPEDFAVYYCQQYGSSSYTFGQGTKLEIK

SEQ ID NO: 1701 - protein, 9 aa, Artificial Sequence
  Synthetic
QQYGSSSYT

SEQ ID NO: 1702 - protein, 122 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGYYYDSSGYHFGFDPWGQGTLVTVSS

SEQ ID NO: 1703 - protein, 16 aa, Artificial Sequence
  Synthetic
AGYYYDSSGYHFGFDP

SEQ ID NO: 1704 - protein, 107 aa, Artificial Sequence; identical to SEQ ID NO: 1212
  Synthetic

SEQ ID NO: 1705 - protein, 9 aa, Artificial Sequence
  Synthetic
QQSYSTPYT

SEQ ID NO: 1706 - protein, 120 aa, Artificial Sequence
  Synthetic
QVQLVESGGGVVQPGRSLRLSCAASGFTFSRYGMHWVRQAPGKGLEWVAVISYDGRNKYYADSVKGRFTISRDNSKNTLYLQMNSLRPEDTAVYYCAKDRAAVDDACDYWGQGTLVTVSS

SEQ ID NO: 1707 - protein, 13 aa, Artificial Sequence
  Synthetic
AKDRAAVDDACDY

SEQ ID NO: 1708 - protein, 107 aa, Artificial Sequence
  Synthetic
DIQMTQSPSSLSASVGDRVTITCRASQSISSYLNWYQQKPGKAPKLLIYGASGLQSGVPSRFSGSGSGTDFTLTISSLQPEDFATYFCQQSYSTPGTFGQGTKVEIK

SEQ ID NO: 1709 - protein, 9 aa, Artificial Sequence
  Synthetic
QQSYSTPGT

SEQ ID NO: 1710 - protein, 121 aa, Artificial Sequence; identical to SEQ ID NO: 161
  Synthetic

SEQ ID NO: 1711 - protein, 14 aa, Artificial Sequence
  Synthetic
VKDLGLGTVDYFDY

SEQ ID NO: 1712 - protein, 106 aa, Artificial Sequence; identical to SEQ ID NO: 162
  Synthetic

SEQ ID NO: 1713 - protein, 8 aa, Artificial Sequence
  Synthetic
QQSYTTVT

SEQ ID NO: 1714 - protein, 117 aa, Artificial Sequence
  Synthetic
EVQLVESGGGLIQPGGSLRLSCAASGLTVSSNYMSWVRQAPGKGLEWVSVIYSGGSTFYADSVKGRFTISRDNSKNTLYLQMNSLRAEDTAVYYCARSLEAYGMDVWGQGTTVTVSS

SEQ ID NO: 1715 - protein, 11 aa, Artificial Sequence
  Synthetic
ARSLEAYGMDV

SEQ ID NO: 1716 - protein, 107 aa, Artificial Sequence
  Synthetic
DIQLTQSPSFLSASVGDRVTITCRASEGISSYLAWYQQKPGKAPKLLIYGASTLQSGVPTRFSGSGSGTEFTLTISSLQPEDFATYHCQQLNSYGYTFGQGTKLEIK

SEQ ID NO: 1717 - protein, 9 aa, Artificial Sequence
  Synthetic
QQLNSYGYT

SEQ ID NO: 1718 - protein, 128 aa, Artificial Sequence
  Synthetic
QLQLQESGSGLVKPSQTLSLTCAVSGGSVSSGDYSWSWIRQPPGKGLEWIGYIYHSGSTYYNPSLKSRLTISVDRSKNQFSLKLTSVTAADTAIYFCARAPLRYCSGGTCYPYYFDYWGQGTLVTVSS

SEQ ID NO: 1719 - protein, 20 aa, Artificial Sequence
  Synthetic
ARAPLRYCSGGTCYPYYFDY

SEQ ID NO: 1720 - protein, 113 aa, Artificial Sequence
  Synthetic
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPPFTFGPGTKVDIK

SEQ ID NO: 1721 - protein, 10 aa, Artificial Sequence
  Synthetic
MQSIQLPPFT

SEQ ID NO: 1722 - protein, 127 aa, Artificial Sequence
  Synthetic
QVQLQESGPGLVKPSETLSLTCTVSGGSVSGGSYYWSWIRQPPGKGLECIGYVFYSGSTNYSPSLKSRVNISADTSKNQFSLKLSSVTAADTAVYYCARGRDFWSGYYTGYHYFDYWGQGTLVTVSS

SEQ ID NO: 1723 - protein, 19 aa, Artificial Sequence
  Synthetic
ARGRDFWSGYYTGYHYFDY

SEQ ID NO: 1724 - protein, 107 aa, Artificial Sequence
  Synthetic
EIVLTQSPATLSLSPGERATLSCRASQSVSSYLAWYQQKPGQAPRLLIYDASNRAAGIPARFSGSGSGTDFTLTISSLEPEDFAVYYCQQRSNWPPSFGQGTRLEIK

SEQ ID NO: 1725 - protein, 9 aa, Artificial Sequence
  Synthetic
QQRSNWPPS

SEQ ID NO: 1726 - protein, 126 aa, Artificial Sequence
  Synthetic
QVQLVQSGAEVKKPGSSVKVSCKASGGTFSSYAFSWVRQAPGQGLEWMGGIIPMFGTPNYAQKFQGRVTITADESTSTAYMELSSLRSEDTAVYYCARDSSRPTPNFYRKYAMDVWGQGTTVTVSS

SEQ ID NO: 1727 - protein, 19 aa, Artificial Sequence
  Synthetic
ARDSSRPTPNFYRKYAMDV

SEQ ID NO: 1728 - protein, 107 aa, Artificial Sequence
  Synthetic
DIQMTQSPSSLSASIGDRVTITCQASQDINNYLNWYQQKPGKAPKLLIYDASNLETGVPSRFSGSGSGTDFTFTISSLQPEDIATYYCQQYDSLRFTFGGGTKVEIK

SEQ ID NO: 1729 - protein, 9 aa, Artificial Sequence
  Synthetic
QQYDSLRFT

SEQ ID NO: 1730 - protein, 129 aa, Artificial Sequence
  Synthetic
QVQLVQSGAEVKKPGASVKVSCKASGYTFSTYGISWVRQAPGQGLEWMGWISAHNGDTNYAQKFQGRVTMTTDTSTSTAYMELRSLRSDDTAVYYCARGRVSLWYGEVPRPAHHGMDVWGQGTTVTVSS

SEQ ID NO: 1731 - protein, 22 aa, Artificial Sequence
  Synthetic
ARGRVSLWYGEVPRPAHHGMDV

SEQ ID NO: 1732 - protein, 107 aa, Artificial Sequence
  Synthetic
DIQMTQSPSSVSASVGDRVTITCRASQGISSWLAWYQQKPGKAPKLLIFAASSLQSGVPSRFSGSGSGTDFILIISSLQPEDFATYYCQQANSFPWAFGQGTKVETK

SEQ ID NO: 1733 - protein, 9 aa, Artificial Sequence
  Synthetic
QQANSFPWA

SEQ ID NO: 1734 - protein, 121 aa, Artificial Sequence
  Synthetic
EVQLVESGGGLVQPGGSLRLSCSASGFTFSRYAMYWVRQAPGKGLQYVSAISSNGDITYYADSVKGRFTISRDNSKNTLYLQMSSLRAEDTAVYYCVKDLGNIAVDVFDHWGQGTLVTVSS

SEQ ID NO: 1735 - protein, 14 aa, Artificial Sequence
  Synthetic
VKDLGNIAVDVFDH

SEQ ID NO: 1736 - protein, 107 aa, Artificial Sequence
  Synthetic
DIQMTQSPSSLSASVGDRLTITCRASQSISSYLNWYQQKPGKAPKLLIYAASSLQSGVPSRFSGSGSGTDFTLTISSLQPEDFATYYCQQSYSTPGTFGQGTKVEIK

SEQ ID NO: 1737 - protein, 9 aa, Artificial Sequence
  Synthetic
QQSYSTPGT

SEQ ID NO: 1738 - protein, 125 aa, Artificial Sequence; identical to SEQ ID NO: 1686
  Synthetic

SEQ ID NO: 1739 - protein, 17 aa, Artificial Sequence
  Synthetic
ARDGCSGGSCYSYWFDP

SEQ ID NO: 1740 - protein, 106 aa, Artificial Sequence
  Synthetic
EIVLTQSPATLSLSPGERATLSCRASQSVSGYLAWYQQKPGQAPRLLMYDASNRATGIPARFSGSGSGTDFTLTISSLEPEDFAVYYCQQRSSWSTFGQGTRLEIK

SEQ ID NO: 1741 - protein, 8 aa, Artificial Sequence
  Synthetic
QQRSSWST

SEQ ID NO: 1742 - protein, 128 aa, Artificial Sequence
  Synthetic
QVQLVESGGGVVQPGRSLRLSCAASGFTFSTYAMHWVRQAPGKGLEWVAFISYDGSNEYYADSVKGRFTISRDNSKNTLYLQMNSLRPEDTAVYYCARPWGPYYDFWSGPGGGAMDVWGQGTTVTVSS

SEQ ID NO: 1743 - protein, 21 aa, Artificial Sequence
  Synthetic
ARPWGPYYDFWSGPGGGAMDV

SEQ ID NO: 1744 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKLEIK

SEQ ID NO: 1745 - protein, 9 aa, Artificial Sequence
  Synthetic
QQYGSSPLT

SEQ ID NO: 1746 - protein, 129 aa, Artificial Sequence
  Synthetic
QVQLVQSGAEVKKPGASVKVSCKASGYTFTGYYMHWVRQAPGQGLEWMGWINPISGGTNYAQRFQGRVTMTTDTSINTAYMELSRLRSDDTAVYYCARDRNYYGSGSYYNPFYNGMDVWGQGTTVTVSS

SEQ ID NO: 1747 - protein, 22 aa, Artificial Sequence
  Synthetic
ARDRNYYGSGSYYNPFYNGMDV

SEQ ID NO: 1748 - protein, 107 aa, Artificial Sequence
  Synthetic
DIQMTQSPSSVSASVGDRVTITCRASHDISSWLVWYQQKPGKAPKLLIYAASSLQSGVPSRFSGSGSGTDFTLTISSLQPEDFASYYCQQANSFPLTFGGGTKVEIK

SEQ ID NO: 1749 - protein, 9 aa, Artificial Sequence
  Synthetic
QQANSFPLT

SEQ ID NO: 1750 - protein, 130 aa, Artificial Sequence
  Synthetic
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQGYYYDSSGYFRLGVYYFDYWGQGTLVTVSS

SEQ ID NO: 1751 - protein, 22 aa, Artificial Sequence
  Synthetic
ARQGYYYDSSGYFRLGVYYFDY

SEQ ID NO: 1752 - protein, 113 aa, Artificial Sequence
  Synthetic
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTPYTFGQGTKLEIK

SEQ ID NO: 1753 - protein, 9 aa, Artificial Sequence
  Synthetic
QQYYSTPYT

SEQ ID NO: 1754 - protein, 120 aa, Artificial Sequence
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDYGDYVTHPDYWGQGTLVTVSS

SEQ ID NO: 1755 - protein, 13 aa, Artificial Sequence
  Synthetic
ARDYGDYVTHPDY

SEQ ID NO: 1756 - protein, 108 aa, Artificial Sequence; identical to SEQ ID NO: 142
  Synthetic

SEQ ID NO: 1757 - protein, 10 aa, Artificial Sequence
  Synthetic
QQSYSTPPWT

SEQ ID NO: 1758 - protein, 127 aa, Artificial Sequence
  Synthetic
QVQLVESGGGVVQPGRSLRLSCAASGFTFRSYGMHWVRQAPGKGLEWVAVISYDGSKKDYADSVKGRFTISRDNSKNTLYLQMNSLRAEDTAVYYCAKQAGVYCSGGTCYEGYFDYWGQGTLVTVSS

SEQ ID NO: 1759 - protein, 20 aa, Artificial Sequence
  Synthetic
AKQAGVYCSGGTCYEGYFDY

SEQ ID NO: 1760 - protein, 108 aa, Artificial Sequence
  Synthetic
EIVLTQSPGTLSLSPGERATLSCRASQSVSSSYLAWYQQKPGQAPRLLISGASSRATGIPDRFSGSESGTDFTLTISRLEPEDFAVYYCQQYGSSPGTFGQGTKVEIK

SEQ ID NO: 1761 - protein, 9 aa, Artificial Sequence
  Synthetic
QQYGSSPGT

SEQ ID NO: 1762 - protein, 126 aa, Artificial Sequence; identical to SEQ ID NO: 137
  Synthetic

SEQ ID NO: 1763 - protein, 20 aa, Artificial Sequence
  Synthetic
ARERRYYDSSGYHRRDGMDV

SEQ ID NO: 1764 - protein, 107 aa, Artificial Sequence; identical to SEQ ID NO: 138
  Synthetic

SEQ ID NO: 1765 - protein, 10 aa, Artificial Sequence
  Synthetic
QQYDNLPPLT

SEQ ID NO: 1766 - protein, 124 aa, Artificial Sequence; identical to SEQ ID NO: 147
  Synthetic

SEQ ID NO: 1767 - protein, 17 aa, Artificial Sequence
  Synthetic
ARFGDYHDNRGYSYSDY

SEQ ID NO: 1768 - protein, 107 aa, Artificial Sequence; identical to SEQ ID NO: 148
  Synthetic

SEQ ID NO: 1769 - protein, 8 aa, Artificial Sequence
  Synthetic
QQYGSSRT

SEQ ID NO: 1770 - protein, 124 aa, Artificial Sequence
  Synthetic
EVQLVESGGHLVKPGGSLRLSCAASGFTFSNAWMSWVRQAPGKGLEWVGRIKSKTDGGTTDYAAPVKGRFTISRDDSKNTLYLQMNSLKTEDTAVYYCCTDVWGFGEQWLLLGWGQGTLVTVSS

SEQ ID NO: 1771 - protein, 15 aa, Artificial Sequence
  Synthetic
CTDVWGFGEQWLLLG

SEQ ID NO: 1772 - protein, 111 aa, Artificial Sequence
  Synthetic
NFMLTQPHSVSESPGKTVTISCTRSSGSIASNYVQWYQQRPGSSPTTVIYEDKQRASGVPDRFSGSIDRSSNSASLTISGLQTEDEADYYCQSYHSSNQGVVFGGGTKLTV

SEQ ID NO: 1773 - protein, 11 aa, Artificial Sequence
  Synthetic
QSYHSSNQGVV

SEQ ID NO: 1774 - protein, 124 aa, Artificial Sequence
  Synthetic
QVQLVESGGGVVQPGRSLRLSCAASGFTFSSYGMHWVRQAPGKGLEWVAVISYDGSNKYYVDSVKGRFTISRDNSKNTLYLQMNSLRAEDTAVYYCAKDPHYYGSGSNNYFDYWGQGTLVTVSS

SEQ ID NO: 1775 - protein, 17 aa, Artificial Sequence
  Synthetic
AKDPHYYGSGSNNYFDY

SEQ ID NO: 1776 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADFYCQVWDSSSDHYVFGTGTKVTVL

SEQ ID NO: 1777 - protein, 11 aa, Artificial Sequence
  Synthetic
QVWDSSSDHYV

SEQ ID NO: 1778 - protein, 123 aa, Artificial Sequence
  Synthetic
QVQLQESGPGLVKPSETLSLTCTVSSGSISSYYWSWIRQPPGKGLEWIGYIYYSGSTNYNPSLKSRVTISVDTSKNQFSLKLSSVTAADTAVYYCARGRRVGIVGDDYYFDYWGQGTLVTVSS

SEQ ID NO: 1779 - protein, 17 aa, Artificial Sequence
  Synthetic
ARGRRVGIVGDDYYFDY

SEQ ID NO: 1780 - protein, 106 aa, Artificial Sequence
  Synthetic
SYVLTQPPSVSVSPGQTARITCSGDALPNQYIYWYQQKPGQAPVLVIYKDSERPSGIPERFSGSSSGTTVTLTISGVQAEDEADYYCQSADSSGTVFGGGTKLTVL

SEQ ID NO: 1781 - protein, 9 aa, Artificial Sequence
  Synthetic
QSADSSGTV

SEQ ID NO: 1782 - protein, 119 aa, Artificial Sequence
  Synthetic
QVQLQQWGAGLLKPSETLSLTCAVYGGSFSGYYWSWIRQAPGKGLEWIGEINHSGSTNYNPSLKSRVTISVDTSKNQFSLKLSSVTAADTAVYYCARDYDTLTGVFDPWGQGTLVTVSS

SEQ ID NO: 1783 - protein, 13 aa, Artificial Sequence
  Synthetic
ARDYDTLTGVFDP

SEQ ID NO: 1784 - protein, 108 aa, Artificial Sequence
  Synthetic
SYVLTQPPSVSVAPGKTARITCGENNIGSKSVHWYQQKPGQAPVLVIYYDSDRPSGIPERFSGSNSGNTATLTISRVDAGDEADYYCQVWESNSDQHVVFGGGTRLTL

SEQ ID NO: 1785 - protein, 12 aa, Artificial Sequence
  Synthetic
QVWESNSDQHVV

SEQ ID NO: 1786 - protein, 125 aa, Artificial Sequence
  Synthetic
EVQLVQSGAEVKKPGESLKISCKGSGYSFTNYWIGWVRQMPGKGLEWMGIIYPGDSDTRYSPSFQGQVTISADKSISTASLQWSSLKASDTAMYFCARQFCTNGVCYPTSHFDYWGQGTLVTVSS

SEQ ID NO: 1787 - protein, 18 aa, Artificial Sequence
  Synthetic
ARQFCTNGVCYPTSHFDY

SEQ ID NO: 1788 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEVGDEADYYCQVWDSSSDHWVFGGGTKLTVL

SEQ ID NO: 1789 - protein, 11 aa, Artificial Sequence
  Synthetic
QVWDSSSDHWV

SEQ ID NO: 1790 - protein, 126 aa, Artificial Sequence
  Synthetic
QVQLVESGGGLVKPGGSLRLSCAASGFTFSDYYMSWIRQAPGKGLEWVSDISGSSFYTNYADSVKGRFTISRDNAKKSLYLQMNSLRADDTAVYYCARATYYYDSSDHGVNWFDPWGQGTLVTVSS

SEQ ID NO: 1791 - protein, 19 aa, Artificial Sequence
  Synthetic
ARATYYYDSSDHGVNWFDP

SEQ ID NO: 1792 - protein, 111 aa, Artificial Sequence
  Synthetic
QSVLTQPPSVSGAPGQRVTISCTGSSSNIGAGYDVHWYQQLPGTAPKLLIYNNNNRPSGVPDRFSGSKSGTSASLAITGLQAEDEADFYCQSYDSSLNDYVFGTGTKVTVL

SEQ ID NO: 1793 - protein, 11 aa, Artificial Sequence
  Synthetic
QSYDSSLNDYV

SEQ ID NO: 1794 - protein, 125 aa, Artificial Sequence
  Synthetic
QVQLQESGPGLVKPSETLSLTCTVSGDSISGYYWSWIRQPPGKGLEWIGYIYYSGSTNYNPSLKSRVTISVDTSKNQFSLKLSSVTAADTAVYYCARTYRYCSSTSCYSSTFDPWGQGILVTVSS

SEQ ID NO: 1795 - protein, 19 aa, Artificial Sequence
  Synthetic
ARTYRYCSSTSCYSSTFDP

SEQ ID NO: 1796 - protein, 110 aa, Artificial Sequence
  Synthetic
QSVLTQPPSASGTPGQMVTISCSGSSSNIGSNYVYWYQHLPGTAPKVLIYRNHLRPSGVPDRFSGSKSGTSASLAISGLRSEDEADYYCATWDDSLSGPVFGGGTKLTVL

SEQ ID NO: 1797 - protein, 11 aa, Artificial Sequence
  Synthetic
ATWDDSLSGPV

SEQ ID NO: 1798 - protein, 130 aa, Artificial Sequence
  Synthetic
QVQLVESGGGVVQPGRSLRLSCAASGFTFSSYAMHWVRQAPGKGLEWVAVISYDGNNKYYADSVQGRFTISRDNSKNTLYLQMNSLRPEDTAVYYCARDFLPQYDFWSGYYDYYYGMDVWGQGTTVTVSS

SEQ ID NO: 1799 - protein, 23 aa, Artificial Sequence
  Synthetic
ARDFLPQYDFWSGYYDYYYGMDV

SEQ ID NO: 1800 - protein, 110 aa, Artificial Sequence
  Synthetic
QSVLTQPASVSGSPGQSITISCTGTSSDVGNYNLVSWYQQHPGKAPKVMIFEVTKRPSGVSNRFSGSKSGNTASLTISGLQAEDEADYYCCSYAGSNTWVFGGGTKLTVL

SEQ ID NO: 1801 - protein, 10 aa, Artificial Sequence
  Synthetic
CSYAGSNTWV

SEQ ID NO: 1802 - protein, 127 aa, Artificial Sequence
  Synthetic
EVQLVESGGGLVQPGGSLRLSCAASGFTFSSYWMSWVRQAPGKGLEWVANIKQDGSEKYYVDSVKGRFTISRDNAKNSLYLQMDSLRAEDTAMYYCAREMYDSSSYYSGGDIWFDPWGQGTLVTVSS

SEQ ID NO: 1803 - protein, 20 aa, Artificial Sequence
  Synthetic
AREMYDSSSYYSGGDIWFDP

SEQ ID NO: 1804 - protein, 106 aa, Artificial Sequence
  Synthetic
SYVLTQPPSVSVSPGQTARITCSGDALPNQYAYWYQQKPGQAPLLLIYKDSERPSGIPERISGSSSGTTVTLTISGVQAEDEADYYCQTADSSGVVFGGGTKLTVL

SEQ ID NO: 1805 - protein, 9 aa, Artificial Sequence
  Synthetic
QTADSSGVV

SEQ ID NO: 1806 - protein, 122 aa, Artificial Sequence
  Synthetic
QVQLVESGGGVVQPGRSLRLSCAASGFTFRNYGMHWVRQAPGKGLEWVADVWNDGSNKYYAHSVKGRFTISRDNSKNTLYLQMNSLRAEDTAVYYCARDRGFDYDSSAFDYWGQGTLVTVSS

SEQ ID NO: 1807 - protein, 15 aa, Artificial Sequence
  Synthetic
ARDRGFDYDSSAFDY

SEQ ID NO: 1808 - protein, 111 aa, Artificial Sequence
  Synthetic
QSVLTQPASVSGSPGQSITISCTGTNSDVGGYNYVSWYQQHPGKAPKLMIYDVSNRPSGVSNRFSGSKSGNTASLTISGLQAEDEADYYCSSYTSSSTPFVFGTGTKVTVL

SEQ ID NO: 1809 - protein, 11 aa, Artificial Sequence
  Synthetic
SSYTSSSTPFV

SEQ ID NO: 1810 - protein, 121 aa, Artificial Sequence
  Synthetic
QVQLQQWGAGLLKPSETLSLTCAVFGGSLSGYFWSWVRQPPGKGLEWIGEINHSEGTNYNPSLKSRVTLSVDTSKNQVSLKLSSVTAADTAVYYCARGPDFSSLDTYFDSWGQGTLVTVSS

SEQ ID NO: 1811 - protein, 15 aa, Artificial Sequence
  Synthetic
ARGPDFSSLDTYFDS

SEQ ID NO: 1812 - protein, 108 aa, Artificial Sequence
  Synthetic
SYVLTQPPSVSVAPGKTARITCGGNNIGSKSVHWYQQKPGQAPILVIYYNSDRPSGIPERFSGSNSGNTATLTISRVEAGDEADYYCQVWDSSSDHVVFGGGTKLTVL

SEQ ID NO: 1813 - protein, 11 aa, Artificial Sequence
  Synthetic
QVWDSSSDHVV

SEQ ID NO: 1814 - protein, 121 aa, Artificial Sequence
  Synthetic
EVQLVESGGGLIQPGGSLRLSCAASGFIVSANYMSWVRQAPGKGLEWVSLIYSGGSTFYADSVKGRFTISRDNSKNTLYLQMNSLRAEDTAVYYCARTLEVHSRGDYFDFWGQGTLVTVSS

SEQ ID NO: 1815 - protein, 15 aa, Artificial Sequence
  Synthetic
ARTLEVHSRGDYFDF

SEQ ID NO: 1816 - protein, 111 aa, Artificial Sequence
  Synthetic
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGWVFGTGTKVTVL

SEQ ID NO: 1817 - protein, 11 aa, Artificial Sequence
  Synthetic
QSYDSSLSGWV

SEQ ID NO: 1818 - protein, 123 aa, Artificial Sequence
  Synthetic
QVQLVESGGGVVQPGRSLRLSCAASGFTFSSFGMHWVRQAPGKGLEWVAVIWDKGNDEHYADSVKGRFTISRDNSKNTLYLQMNSLRAEDTAVYYCARDRWESWIQNGYFDYWGQGTLVTVSS

SEQ ID NO: 1819 - protein, 16 aa, Artificial Sequence
  Synthetic
ARDRWESWIQNGYFDY

SEQ ID NO: 1820 - protein, 110 aa, Artificial Sequence
  Synthetic
QSVLTQPASVSGSPGQSITISCTGTSSDVGSFNLVSWYQLHPGKAPKLMIYEVSKRPSGVSNRFSGSKSGNTASLTISGLQAEDEADYYCCSYAGSSTYVFGTGTKVTVL

SEQ ID NO: 1821 - protein, 10 aa, Artificial Sequence
  Synthetic
CSYAGSSTYV

SEQ ID NO: 1822 - protein, 130 aa, Artificial Sequence
  Synthetic
EVQLVESGGDLVQPGRSLRLSCAASGFTFEDYAMHWVRQAPGKGLEWVSGVSWNSGTIGYADSVKGRFTISRDNANNSLYLHMRRLTPEDTALYYCVKAPLAPGFDYGSGSYYKIGMDVWGQGTTVTVSS

SEQ ID NO: 1823 - protein, 23 aa, Artificial Sequence
  Synthetic
VKAPLAPGFDYGSGSYYKIGMDV

SEQ ID NO: 1824 - protein, 107 aa, Artificial Sequence
  Synthetic
SYVLTQPPSVSVAPGQTARITCGGNNIGSKSVHWYQQKPGQGPVLVVYADTDRPSGIPERFSGSNSGKTATLTITRVEAGDEADYYCQVWDSSSDHVVFGGGTKLTV

SEQ ID NO: 1825 - protein, 11 aa, Artificial Sequence
  Synthetic
QVWDSSSDHVV

SEQ ID NO: 1826 - protein, 123 aa, Artificial Sequence
  Synthetic
QVQLVQSGAEVKKPGSSVKVSCKASGGTFSSYAIIWVRQAPGQGLEWMGRIIPMIGIANYAQKFQGRVTITADKSTSTAYMELSSLRSEDTAVYYCARAAPGKCTSTSCYDPWGQGTLVTVSS

SEQ ID NO: 1827 - protein, 16 aa, Artificial Sequence
  Synthetic
ARAAPGKCTSTSCYDP

SEQ ID NO: 1828 - protein, 106 aa, Artificial Sequence
  Synthetic
QSVLTQPPSVFGAPGQRVTISCIGSNLNIGAGYDVHWYQQLPGTAPKLLIYDDTNRPSGVPDRFSGSKSGTSASLAITGLQEDEDDYYCQSYDSSLIGSIFGGGTK

SEQ ID NO: 1829 - protein, 11 aa, Artificial Sequence
  Synthetic
QSYDSSLIGSI

SEQ ID NO: 1830 - protein, 121 aa, Artificial Sequence
  Synthetic
EVQLVQSGAELKKPGESLKISCKGSGYSFTSYWIGWVRQMPGKGLEWMGIIYPGDSDTRYSPSFQGQVTISADKSISTAYLQWSSLKASDTAMYYCARSIAATNIGWFDPWGQGTLVTVSS

SEQ ID NO: 1831 - protein, 14 aa, Artificial Sequence
  Synthetic
ARSIAATNIGWFDP

SEQ ID NO: 1832 - protein, 110 aa, Artificial Sequence
  Synthetic
NFMLTQPHSVSESPGKTVTISCTRSSGFIASNYVQWYQQRPGSSPTTVIYEDNQRPSGVPDRFSGSIDSSSDSASLTISGLKTEDEADYYCQSYDRGNWVFGGGTKLTVL

SEQ ID NO: 1833 - protein, 9 aa, Artificial Sequence
  Synthetic
QSYDRGNWV

SEQ ID NO: 1834 - protein, 126 aa, Artificial Sequence
  Synthetic
QVQLVESGGGVVQPGRSLRLSCAASGFTFSSYAMHWVRQAPGKGLEWVAVISYDGSSKYYADSVKGRFTISRDNSKNTLFLQMSSLRAEDTAVYYCPRGASLGLPSYYYYFGMDVWGQGTTVTVSS

SEQ ID NO: 1835 - protein, 19 aa, Artificial Sequence
  Synthetic
PRGASLGLPSYYYYFGMDV

SEQ ID NO: 1836 - protein, 109 aa, Artificial Sequence
  Synthetic
QSVLTQPPSASGTPGQRVTISCSGSSSSIGSNYVYWYQQLPGTAPKLLIYRNNLRPSGVPDRFSGSKSGTSASLAISGLRSEDEADYYCAAWDDSLSGVFGGGTKLTVL

SEQ ID NO: 1837 - protein, 10 aa, Artificial Sequence
  Synthetic
AAWDDSLSGV

SEQ ID NO: 1838 - protein, 119 aa, Artificial Sequence
  Synthetic
EVQLVESGGGLVQPGGSLRLSCAASEFIVSRNYMSWVRQAPGRGVEWVSLIYSGGSTFYADSVKDRFTISRDNSMNTLYVQMNSLRAEDTAIYYCARTMPYSVDYLDYWGQGTLVTVSS

SEQ ID NO: 1839 - protein, 13 aa, Artificial Sequence
  Synthetic
ARTMPYSVDYLDY

SEQ ID NO: 1840 - protein, 112 aa, Artificial Sequence
  Synthetic
QSVLTQPPSVSGAPGQRVTISCTGSSSNIGAGSDVHWYQQLPGTAPKLLIYGNSNRPSGVPDRFSGSKSGTSASLAITGLRAEDEADYYCQSYDSSLSALGVFGGGTKLTVL

SEQ ID NO: 1841 - protein, 12 aa, Artificial Sequence
  Synthetic
QSYDSSLSALGV

SEQ ID NO: 1842 - protein, 126 aa, Artificial Sequence
  Synthetic
QVQLQESGPGLVKPSQTLSLTCTVSGGSFSSGDYYWSWIRQPPGKGPEWIGYISYSGSAYYNPSLKSRLTISVDASKSQFSLKLSSVTAADTAVYFCARLIGFCSSGSCYGEFDPWGQGTLVTISS

SEQ ID NO: 1843 - protein, 18 aa, Artificial Sequence
  Synthetic
ARLIGFCSSGSCYGEFDP

SEQ ID NO: 1844 - protein, 110 aa, Artificial Sequence
  Synthetic
QSVLTQPPSASGTPGQRVTISCSGSSSNIGSNYVCWYQQLPGTAPKLLIYRNNLRPSGVPDRFSGSKSGTSASLAISGLRSEDEADYYCAAWDDSLSVWVFGGGTKLTVL

SEQ ID NO: 1845 - protein, 11 aa, Artificial Sequence
  Synthetic
AAWDDSLSVWV

SEQ ID NO: 1846 - protein, 121 aa, Artificial Sequence
  Synthetic
QVQLVQSGAEVKKPGASVKVSCKASGYTFTSHYMHWVRQAPGQGLEWMGIINPSGVYTSYAQKFQGRVTMTSDTSTSTVYMELSSLRSEDTAVYYCTRGSTVTEDNWFDPWGQGTLVTVSS

SEQ ID NO: 1847 - protein, 14 aa, Artificial Sequence
  Synthetic
TRGSTVTEDNWFDP

SEQ ID NO: 1848 - protein, 110 aa, Artificial Sequence
  Synthetic
QSVLTQPPSASGTPGQRVTISCSGSSSNIGSSYLYWYQQLPGTAPKLLIYRNNLRPSGVPDRFSGSKSGTSASLAISGLRSEDEADYYCAAWDDSLSGVVFGGGTKLTVL

SEQ ID NO: 1849 - protein, 11 aa, Artificial Sequence
  Synthetic
AAWDDSLSGVV

SEQ ID NO: 1850 - protein, 123 aa, Artificial Sequence
  Synthetic
QVQLVESGGGVVQPGRSLRLSCTASGFAFFSYAMHWVRQAPGKGLEWVSVISFDGSNVFYADSVKGRFTISRDNSKNTLYLQMNSLRAEDSAVYYCARGEMATIGWDYYFDYWGQGTPVTVSS

SEQ ID NO: 1851 - protein, 16 aa, Artificial Sequence
  Synthetic
ARGEMATIGWDYYFDY

SEQ ID NO: 1852 - protein, 110 aa, Artificial Sequence
  Synthetic
QSVLTQEPSFSVSPGGTVTLTCGLSSGSVSTSHYPSWYQQTPGQAPRTLIYITNTRSSGVPDRFSGSILGNKAALTITGAQADDESDYHCVLYMGSGIWVFGGGTKLTVL

SEQ ID NO: 1853 - protein, 10 aa, Artificial Sequence
  Synthetic
VLYMGSGIWV

SEQ ID NO: 1854 - protein, 126 aa, Artificial Sequence
  Synthetic
QVQLVQSGSEVKKPGASVKVSCRASGYTFTNYYIHWVRQAPGQGLEWMGIINPSGAGTSYAQKFQGRVTLTRDTSTSAVYMELSSLRSEDTAVYYCARDFRGDTSSWHDYYYMDVWGKGTTVTVSS

SEQ ID NO: 1855 - protein, 19 aa, Artificial Sequence
  Synthetic
ARDFRGDTSSWHDYYYMDV

SEQ ID NO: 1856 - protein, 110 aa, Artificial Sequence
  Synthetic
QSVLTQPPSASGTPGQRVTISCSGSSSNIGSNYIFWYQQLPGTAPKLLIYKNNQRPSGVPDRFSGSKSGTSASLAISGLRSEDEADYYCAAWDDILSDVVFGGGTKLTVL

SEQ ID NO: 1857 - protein, 11 aa, Artificial Sequence
  Synthetic
AAWDDILSDVV

SEQ ID NO: 1858 - protein, 129 aa, Artificial Sequence
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCTRDLFPQGVVPTRYHYYYGMDVWGQGTTVTVSS

SEQ ID NO: 1859 - protein, 22 aa, Artificial Sequence
  Synthetic
TRDLFPQGVVPTRYHYYYGMDV

SEQ ID NO: 1860 - protein, 110 aa, Artificial Sequence
  Synthetic
QSVLTQPPSASGTPGQRVTISCSGSDSNIGSNTVNWYQQLPGTAPRLLIYNNYQRPSGVPDRFSGSKSGTSASLAISGLQSEDEADYYCAAWDDSLNGPVFGGGTKLTVL

SEQ ID NO: 1861 - protein, 11 aa, Artificial Sequence
  Synthetic
AAWDDSLNGPV

SEQ ID NO: 1862 - protein, 124 aa, Artificial Sequence
  Synthetic
EVQLVESGGGLVQPGGSLRLSCAASGIIVSSNYMNWVRQAPGKGLEWVSVIYSGGSTFYADSVKGRFTISRDNSKNTLYLQMNSLRAEDTAVYFCAREYYYDSSGNYPDAFDIWGQGTMVTVSS

SEQ ID NO: 1863 - protein, 18 aa, Artificial Sequence
  Synthetic
AREYYYDSSGNYPDAFDI

SEQ ID NO: 1864 - protein, 112 aa, Artificial Sequence
  Synthetic
QSVLTQPPSVSGAPGQRVTISCTGSSSNIGAGYDVHWYQQLPGTAPKLLIYGNTNRPSGVPDRFSGSKSGTSASLAITGLQAEDEADYYCQSYDSSLSGSKVFGGGTKLTVL

SEQ ID NO: 1865 - protein, 12 aa, Artificial Sequence
  Synthetic
QSYDSSLSGSKV

SEQ ID NO: 1866 - protein, 119 aa, Artificial Sequence
  Synthetic
QVQLQQWGAGLLKPSETLSLTCAVYGGSFSGYYWSWIRQPPGKGLEWIGEINHSGNTNYNSSLKSRVTISVDTSKNQFSLKLSSVTAADTAVYYCARLQDNIVAPFDYWGQGTLVTVSS

SEQ ID NO: 1867 - protein, 13 aa, Artificial Sequence
  Synthetic
ARLQDNIVAPFDY

SEQ ID NO: 1868 - protein, 105 aa, Artificial Sequence
  Synthetic
SYVLTQPPSVSVAPGKTARITCGGNSIGSKSVHWYQQKPGQAPVLVISYDYDRPSGIPERFSGSNSGNTATLTISRVEAGDEADYYCHVWDTSVVFGGGTKLTVL

SEQ ID NO: 1869 - protein, 8 aa, Artificial Sequence
  Synthetic
HVWDTSVV

SEQ ID NO: 1870 - protein, 124 aa, Artificial Sequence
  Synthetic
QVQLVQSGAEVKKPGASVKVSCKASGYTFTGYYMHWVRQAPGQGLEWMGRINPNSGGTNYAQKFQGRVTMTRDTSISTAYMELSRLRSNDTAVYYCARGPTVVVGAAAHWFDPWGQGTLVTVSS

SEQ ID NO: 1871 - protein, 17 aa, Artificial Sequence
  Synthetic
ARGPTVVVGAAAHWFDP

SEQ ID NO: 1872 - protein, 110 aa, Artificial Sequence
  Synthetic
QSVLTQSPSASGTPGQRVTISCSGSSSNIGSNYVYWYQQLPGTAPKLLIYRNHLRPSGVPDRFSGSKSGTSASLAISGLRSEDEADYYCAAWDDSLSAVVFGGGTKLTVL

SEQ ID NO: 1873 - protein, 11 aa, Artificial Sequence
  Synthetic
AAWDDSLSAVV

SEQ ID NO: 1874 - protein, 121 aa, Artificial Sequence
  Synthetic
EVQLLESGRGLVQPGGSLRLSCAASGFTFSDYAMSWVRQAPGKGLEWVSAITGSGGTTYSADSVKGRFTISRDNSKNTLYLQMNSLRAEDTAVYYCAKGPAVGADPQFDYWGQGALVTVSS

SEQ ID NO: 1875 - protein, 14 aa, Artificial Sequence
  Synthetic
AKGPAVGADPQFDY

SEQ ID NO: 1876 - protein, 109 aa, Artificial Sequence
  Synthetic
QSVLTQPPSASATPGQTVTISCSGSSSNIGSNYVYWYQQLPGTAPKVLIYRNHLRPSGVPDRFSGSKSGTSASLAISGVRSEDEADYYCAAWDDRLTVLFGGGTKLTVL

SEQ ID NO: 1877 - protein, 10 aa, Artificial Sequence
  Synthetic
AAWDDRLTVL

SEQ ID NO: 1878 - protein, 118 aa, Artificial Sequence
  Synthetic
EVQLVESGGGLIQPGGSLRLSCAASGFTVSSHYMTWVRQAPGKGLECVSIIYSGGGTYYADSVKGRFTISRDNSKNTLYLQMNSLRAEDTAVYYCARLYSLTYYFDYWGQGTLVTVSS

SEQ ID NO: 1879 - protein, 12 aa, Artificial Sequence
  Synthetic
ARLYSLTYYFDY

SEQ ID NO: 1880 - protein, 107 aa, Artificial Sequence
  Synthetic
SYVLTQPPSVSVAPGQTARITCGGNNIGSKNVHWYQQKPGQAPVLVVYDDSDRPSGIPERFSGSNSGNTATLTISRVEAGDEADYYCQVWESSSDWVFGGGTKLTVL

SEQ ID NO: 1881 - protein, 10 aa, Artificial Sequence
  Synthetic
QVWESSSDWV

SEQ ID NO: 1882 - protein, 119 aa, Artificial Sequence
  Synthetic
QVQLVQSGAEVKKPGASVKVSCKASGYTFTSYDINWVRQATGQGLEWMGWMNPNSGSRGYAQKFQGRVTMTRNTSISTAYMELSSLRSEDTAVYYCARGGGLTGDVDYWGQGTLVTVSS

SEQ ID NO: 1883 - protein, 12 aa, Artificial Sequence
  Synthetic
ARGGGLTGDVDY

SEQ ID NO: 1884 - protein, 108 aa, Artificial Sequence
  Synthetic
SYVLTQPPSVSVAPGQTARITCGGNNIGSKNVHWYQQKPGQAPVLVVFDDSDRPSGIPERFSGSNSGNTATLTISRVEAGDEADYYCQVWESSGDHVVFGGGTKLTVL

SEQ ID NO: 1885 - protein, 11 aa, Artificial Sequence
  Synthetic
QVWESSGDHVV

SEQ ID NO: 1886 - protein, 124 aa, Artificial Sequence
  Synthetic
EVQLVESGGGLVQPGGSLRLSCAASGFTFGSYSMNWVRQAPGKGLEWVSYISSSSGAIYYADSVKGRFTISRDNVKNSLYLQMNSLRDEDTAVYYCARGGIVVVTAIVALFDYWGQGTLVTVSS

SEQ ID NO: 1887 - protein, 17 aa, Artificial Sequence
  Synthetic
ARGGIVVVTAIVALFDY

SEQ ID NO: 1888 - protein, 110 aa, Artificial Sequence
  Synthetic
QSVLTQPPSASGTPGQRVTISCSGSSSNIGSNYVYWYQQLPGTAPKLLIYRTHLRPSGVPDRFSGSKSGTSASLAISGLRSEDEADYYCAAWDDSLSVVVFGGGTKLTVL

SEQ ID NO: 1889 - protein, 11 aa, Artificial Sequence
  Synthetic
AAWDDSLSVVV

SEQ ID NO: 1890 - protein, 127 aa, Artificial Sequence
  Synthetic
QVQLVESGGGVVQPGRSLRLSCAASGFTFSSYAMHWVRQAPGKGLEWVAFISYDGSNKYYADSVKGRFTISRDSSKNTLFLQMNSLRAEDTAVYYCVRMDTVTADDDYYYYYGMDVWGQGTTVTVSS

SEQ ID NO: 1891 - protein, 20 aa, Artificial Sequence
  Synthetic
VRMDTVTADDDYYYYYGMDV

SEQ ID NO: 1892 - protein, 108 aa, Artificial Sequence
  Synthetic
SYVLTQPPSVSVSPGQTARITCSGDALPKQYAYWYQQKPGQAPVVVIYKDSERPSGIPERFSGSSSGTTVTLTISGVQAEDEADYYCQSADSRGTYWVFGGGTKLTVL

SEQ ID NO: 1893 - protein, 11 aa, Artificial Sequence
  Synthetic
QSADSRGTYWV

SEQ ID NO: 1894 - protein, 119 aa, Artificial Sequence
  Synthetic
EVQLVESGGGLVQPGGSLRLSCAASGIIVSSNYMRWVRQAPGKGLEWVSVIYSGGSTYYADSVKGRFTISRDNSKNTLYLQMNSLRAEDTAVYYCARSLYSSSWYNDYWGQGTLVTVSS

SEQ ID NO: 1895 - protein, 13 aa, Artificial Sequence
  Synthetic
ARSLYSSSWYNDY

SEQ ID NO: 1896 - protein, 113 aa, Artificial Sequence
  Synthetic
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSDSDVVFGGGTKLTVL

SEQ ID NO: 1897 - protein, 13 aa, Artificial Sequence
  Synthetic
QSYDSSLSDSDVV

SEQ ID NO: 1898 - protein, 124 aa, Artificial Sequence
  Synthetic
QVQLVQSGSELKKPGASVKVSCKASGYTFISHAMNWVRQAPGQGLEWMGWINTNTGNPTYAQGFTGRFVFSLDTSVSTAYLQISSLMPEDTAVYYCARGVVVAVTGIDNWFDPWGQGTLVTVSS

SEQ ID NO: 1899 - protein, 17 aa, Artificial Sequence
  Synthetic
ARGVVVAVTGIDNWFDP

SEQ ID NO: 1900 - protein, 110 aa, Artificial Sequence
  Synthetic
QSVLTQSPSASGTPGQRVTISCSGSSSNIGSNYVYWYQQLPGTAPKLLIYRNSLRPSGVPDRFSGSKSGTSASLAISGLRSADEADYYCAAWDDSLSGVVFGGGTKLIVL

SEQ ID NO: 1901 - protein, 11 aa, Artificial Sequence
  Synthetic
AAWDDSLSGVV

SEQ ID NO: 1902 - protein, 126 aa, Artificial Sequence
  Synthetic
QVQLVQSGAEVKKPGASVKVSCTASGYTFTGYSMHWVRQAPGQGLEWMGRINPNSGGTDYAQKFQGRVTMTRDTSISTAYMELSRLRSDDTAVYYCARVGELLGINYYYYYGMDVWGQGTTVTVSS

SEQ ID NO: 1903 - protein, 19 aa, Artificial Sequence
  Synthetic
ARVGELLGINYYYYYGMDV

SEQ ID NO: 1904 - protein, 110 aa, Artificial Sequence
  Synthetic
QSVLTQPPSASATPGQRVTISCSGSSSNIGSNYVYWYQQLPGTAPKLLIYRNNHRPSGVPDRFSGSKSGSSASLAISGLRSEDEADYYCAAWDDSLSGVVFGGGTKLTVL

SEQ ID NO: 1905 - protein, 11 aa, Artificial Sequence
  Synthetic
AAWDDSLSGVV

SEQ ID NO: 1906 - protein, 121 aa, Artificial Sequence
  Synthetic
QVQLVESGGGVVQPGRSLRLSCAASGFTFSSYAMHWVRQAPGKGLEWVAVISYDGGNKHYADSVKGRFTISRDNSKNTLYLQMNSLRAEDTAVYYCAGTYYNILTGYFDYWGQGTLVTVSS

SEQ ID NO: 1907 - protein, 14 aa, Artificial Sequence
  Synthetic
AGTYYNILTGYFDY

SEQ ID NO: 1908 - protein, 108 aa, Artificial Sequence
  Synthetic
SYVLTQPPSVSVAPGQTARITCGGNNIGSKNVHWYQQNPGQAPVLVVYDDSDRPSGIPERFSGSNSGNTATLTINRVEAGDEADYYCQVWDSSSDPWVFGGGTKLTVL

SEQ ID NO: 1909 - protein, 11 aa, Artificial Sequence
  Synthetic
QVWDSSSDPWV

SEQ ID NO: 1910 - protein, 124 aa, Artificial Sequence
  Synthetic
QVQLVESGGGVVQPGRSLRLSCAASGFNFSSYDIHWVRQAPGKGLEWVSVISSDGSKKYYADSVKGRFTISRDNSKNKLYLQMNSLRAEDTAVYYCAKGGYTTRYYVSLLFDYWGQGTLVTVSS

SEQ ID NO: 1911 - protein, 17 aa, Artificial Sequence
  Synthetic
AKGGYTTRYYVSLLFDY

SEQ ID NO: 1912 - protein, 111 aa, Artificial Sequence
  Synthetic
QSVLTQPPSASGTPGQRVTISCSGSSSNIGSNYVYWYQQLPGTAPKLLIYRNHLRPSGVPDRFSGSKSGTSASLAISGLRSEDEADYYCAAWDDSLSGQGVFGTGTKVTVL

SEQ ID NO: 1913 - protein, 12 aa, Artificial Sequence
  Synthetic
AAWDDSLSGQGV

SEQ ID NO: 1914 - protein, 121 aa, Artificial Sequence
  Synthetic
EVQLVESGGGLVQPGRSLRLSCAASGFTFDDYAMHWVRQAPGKGLEWVSGISWNSGSKGYVDSVKGRFTISRDNAKNSLYLQMNSLRAEDTALYYCAKDIGGGFGDYFDYWGQGTLVTVSS

SEQ ID NO: 1915 - protein, 14 aa, Artificial Sequence
  Synthetic
AKDIGGGFGDYFDY

SEQ ID NO: 1916 - protein, 109 aa, Artificial Sequence
  Synthetic
SYVLTQPPSVSVAPGKTARITCGGNNIGSKSVHWYQQKPGQAPVLVIYYDSGRPSGIPERFSGSNSGNTATLTISRVEAGDEADYYCQVWDSNSDHPYVFGTGTKVTVL

SEQ ID NO: 1917 - protein, 12 aa, Artificial Sequence
  Synthetic
QVWDSNSDHPYV

SEQ ID NO: 1918 - protein, 121 aa, Artificial Sequence
  Synthetic
EVQLVESGGGLVQPGGSLRLSCAASGFTFSGYHLHWVRQATGKGLEWVSHIDTAGDTNYADSVKGRFTISRENAKKSFYLQMNSLRAGDTAVYYCARGGNGGDYVGGFDKWGQGTLVTVSS

SEQ ID NO: 1919 - protein, 15 aa, Artificial Sequence
  Synthetic
ARGGNGGDYVGGFDK

SEQ ID NO: 1920 - protein, 108 aa, Artificial Sequence
  Synthetic
SYVLTQSPSVSVAPGQTARITCGGNNIGGKSVHWYQQKPGQAPVLVVYDDSARPSGIPERFSGSNSGNTATLTISRVEAGDEADYYCQVWDSSTDHRVFGGGTKLTVL

SEQ ID NO: 1921 - protein, 11 aa, Artificial Sequence
  Synthetic
QVWDSSTDHRV

SEQ ID NO: 1922 - protein, 122 aa, Artificial Sequence
  Synthetic
EVQLVQSGAEVKKPGESLRISCKGSGYSFSNYWISWVRQMPGKGLEWMGKIDPGDSYTIYSPSFQGHVTISTDKSISTAYLQWSSLETSDTAIYYCARHDREYHQAGWFDPWGQGTLVTVSS

SEQ ID NO: 1923 - protein, 15 aa, Artificial Sequence
  Synthetic
ARHDREYHQAGWFDP

SEQ ID NO: 1924 - protein, 107 aa, Artificial Sequence
  Synthetic
DIQMTQSPSTLSASVGDRVTITCRASQSISNWLAWYQQRPGKAPKLLISDASSLESGVPSRFSGGGSGTEFTLTISSLQPDDFATYYCQQYNTYSHTFGQGTKVEIK

SEQ ID NO: 1925 - protein, 9 aa, Artificial Sequence
  Synthetic
QQYNTYSHT

SEQ ID NO: 1926 - protein, 120 aa, Artificial Sequence
  Synthetic
EVQLVQSGAEVKKPGESLKISCKSPGYSFTSYWIGWVRQMPEKGLEWMGIIYLGDSETTYNPSFQGQVTISADKSISTAYLQWSSLKASDTAMYYCARQPLGQGGYSDFWGQGTLVTVSS

SEQ ID NO: 1927 - protein, 13 aa, Artificial Sequence
  Synthetic
ARQPLGQGGYSDF

SEQ ID NO: 1928 - protein, 107 aa, Artificial Sequence
  Synthetic
DIQMTQSPSTLSASVGDRVTITCRASQSISTWLAWYQQKPGKAPKLLIYDASNLESGVPSRFSGSGSGTEFTLTISSLQPDDFATYYCQQYNSYPSTFGQGTKVDIK

SEQ ID NO: 1929 - protein, 9 aa, Artificial Sequence
  Synthetic
QQYNSYPST

SEQ ID NO: 1930 - protein, 120 aa, Artificial Sequence
  Synthetic
EVQLVQSGAEVKKPGESLKISCQGSGFRITNWIGWVRQMPEKGLEWMGIIYPGDSDTRYSPSFQGQVTISADKSISTAYLQWSSLKASDTAMYYCARTTHRSPHEAFDIWGQGTMVTVSS

SEQ ID NO: 1931 - protein, 14 aa, Artificial Sequence
  Synthetic
ARTTHRSPHEAFDI

SEQ ID NO: 1932 - protein, 108 aa, Artificial Sequence
  Synthetic
EIVLTQSPGTLSLSPGERATLSCRASRRVSSSYLAWYQQKPGQAPRLLIYGASSRATGIPDRFSGSGSGTDFTLTISRLEPEDFAVYYCQQYGTSTGTFGQGTKLEIK

SEQ ID NO: 1933 - protein, 9 aa, Artificial Sequence
  Synthetic
QQYGTSTGT

SEQ ID NO: 1934 - protein, 124 aa, Artificial Sequence
  Synthetic
QVQLVQSGAEVKKPGASVKVSCKASGYTFTGYYMYWVRQAPGQGLEWMGRINPISGGTNYAQKFQGRVTMTRDTSIRTAYVELSRLRSDDTAVYYCARAPYYYDSGSVGGFDYWGQGTLVTVSS

SEQ ID NO: 1935 - protein, 17 aa, Artificial Sequence
  Synthetic
ARAPYYYDSGSVGGFDY

SEQ ID NO: 1936 - protein, 112 aa, Artificial Sequence
  Synthetic
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLSWTFGQGTKVEIK

SEQ ID NO: 1937 - protein, 9 aa, Artificial Sequence
  Synthetic
MQSIQLSWT

SEQ ID NO: 1938 - protein, 122 aa, Artificial Sequence
  Synthetic
EVQLLESGGGLVQPGGSLRLSCAASGFTFSSYAMSWVRQAPGKGLEWVSGISGDGGITYYADSVKGRFAISRDNSKNTLYLQLNSLRAEDTAVYYCAKDLGNIVATEVIDYWGQGTLVTVSS

SEQ ID NO: 1939 - protein, 15 aa, Artificial Sequence
  Synthetic
AKDLGNIVATEVIDY

SEQ ID NO: 1940 - protein, 107 aa, Artificial Sequence
  Synthetic
DIQMTQSPSSLSASVGDRVTITCRASQSISRYLNWYQQKPGKAPKLLIYVASSLQSGVPSRFSASGSGTDFTLTISSLQPEDFATYYCQQSYSTPPTFGQGTRVEIK

SEQ ID NO: 1941 - protein, 9 aa, Artificial Sequence
  Synthetic
QQSYSTPPT

SEQ ID NO: 1942 - protein, 125 aa, Artificial Sequence
  Synthetic
QVQLVQSGAEVKKPGASVNISCKASGYTFTTYAMHWLRQAPGQRLEWMGWINGGNGNTKYSLKFQDRVTITRDTSASTAYMELGSLKSEDTAVYYCARDPPSYYYDLGNYMFDYWGQGTLVTVSS

SEQ ID NO: 1943 - protein, 18 aa, Artificial Sequence
  Synthetic
ARDPPSYYYDLGNYMFDY

SEQ ID NO: 1944 - protein, 108 aa, Artificial Sequence
  Synthetic
EIVLTQSPVSLSLSPGERATLSCRASQSFGGSYLAWFQQKPGQAPRLLIYGASSRATGIPDRFSGSGSGTDFTLTISRLEPEDFAVYSCLQYGSSPLTFGQGTKVEIK

SEQ ID NO: 1945 - protein, 9 aa, Artificial Sequence
  Synthetic
LQYGSSPLT

SEQ ID NO: 1946 - protein, 121 aa, Artificial Sequence
  Synthetic
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARVDFDRDRYWYFDLWGRGTLVTVSS

SEQ ID NO: 1947 - protein, 15 aa, Artificial Sequence
  Synthetic
ARVDFDRDRYWYFDL

SEQ ID NO: 1948 - protein, 108 aa, Artificial Sequence
  Synthetic
DIQMTQSPSSLSASVGDRVTITCRASQSISSYLNWYQQKPGKAPKLLIYVASSLQSGVPSRFSGSGSGTDFTLTISSLQPEDFATYYCQQSYSAPPFTFGPGTKVDIK

SEQ ID NO: 1949 - protein, 10 aa, Artificial Sequence
  Synthetic
QQSYSAPPFT

SEQ ID NO: 1950 - protein, 120 aa, Artificial Sequence
  Synthetic
EVQLVQSGAEVKKPGESLRISCKGSGYSFTSYWISWVRQMPGKGLEWMGRIDPSDSYTNYSPSFQGHVTISADKSISTAYLQWSSLKASDTAIYYCARHSYGDYSDFDYWGQGTLVTVSS

SEQ ID NO: 1951 - protein, 13 aa, Artificial Sequence
  Synthetic
ARHSYGDYSDFDY

SEQ ID NO: 1952 - protein, 108 aa, Artificial Sequence
  Synthetic
EIVLTQSPGTLSLSPGERATLSCRASQSVSSSYLAWYQQKPGQAPRLLIYAASSGATGIPDRFSGSGSGTDFTLTISRLEPEDFAVYYCQQYGTSAVTFGQGTKVEIK

SEQ ID NO: 1953 - protein, 9 aa, Artificial Sequence
  Synthetic
QQYGTSAVT

SEQ ID NO: 1954 - protein, 121 aa, Artificial Sequence
  Synthetic
QVQLVESGGGLVKPGGSLRLSCAASGFTFSDHYMSWIRQAPGKGLEWVSYISTTSTYTNYADSVKGRFTISRDNAKNSLYLQMNSLRAEDTAVYYCATTAVPARFLNFDYWGQGTLVTVSS

SEQ ID NO: 1955 - protein, 14 aa, Artificial Sequence
  Synthetic
ATTAVPARFLNFDY

SEQ ID NO: 1956 - protein, 106 aa, Artificial Sequence
  Synthetic
DIQMTQSPSSLSASVGDRVTITCRASQSIDRLLNWYQQKPGKAPKLLIYAASSLQSGVPSRFSGSGSGTDFTLTISSLQPEDFATYYCQQSYSTPTFGQGTRLDIK

SEQ ID NO: 1957 - protein, 8 aa, Artificial Sequence
  Synthetic
QQSYSTPT

SEQ ID NO: 1958 - protein, 118 aa, Artificial Sequence
  Synthetic
EVQLVESGGGLIQPGGSLRLSCAASGLTVSSNYMTWVRQAPGKGLEWVSLIYAGGSTYYADSVKGRFTISRDNSKNTLYLQMNSLRAEDTAVYYCARDLQERGAFDIWGQGTMVTVSS

SEQ ID NO: 1959 - protein, 12 aa, Artificial Sequence
  Synthetic
ARDLQERGAFDI

SEQ ID NO: 1960 - protein, 112 aa, Artificial Sequence
  Synthetic
DIVMTQSPDSLAVSLGERATINCKSSQTVLYSSNSKNYLAWYQQKPGQPPKLLIYSASTRESGVPDRFSGSGSETDFTLTISSLQAEDVAVYYCQQYYSTPRTFGQGTKLEI

SEQ ID NO: 1961 - protein, 9 aa, Artificial Sequence
  Synthetic
QQYYSTPRT

SEQ ID NO: 1962 - protein, 126 aa, Artificial Sequence
  Synthetic
QVQLQQWGAGLLKPSETLSLTCAVSGGSYSGDNWSWIRQPPGKGLEWIGEINHSGSTNYNPSLKSRVTISVDTSKNQSSLKLSSVTAADTAVYFCAGETQVVPANIRFYYYYMDVWGKGTTVIVSS

SEQ ID NO: 1963 - protein, 20 aa, Artificial Sequence
  Synthetic
AGETQVVPANIRFYYYYMDV

SEQ ID NO: 1964 - protein, 107 aa, Artificial Sequence
  Synthetic
DIQMTQSPSSLSASVGDRVTITCRASQTISSYLNWFQQKPGKAPKLLIYAASNLQSGVPSRFSGSGSGTDFTLTISSLQPEDFATYYCQQSYTTPYTFGQGTKLEIK

SEQ ID NO: 1965 - protein, 9 aa, Artificial Sequence
  Synthetic
QQSYTTPYT

SEQ ID NO: 1966 - protein, 119 aa, Artificial Sequence
  Synthetic
QVQLVQSGSEVKKPGSSVKVSCRASGGTFSMYGITWVRQAPGQGLEWMGRIIPIFGITNYAQKFQGRVTITADKSTSTAYMELSSLRSEDTAVYYCARVKDGYDAFHIWGQGTMVTVSS

SEQ ID NO: 1967 - protein, 12 aa, Artificial Sequence
  Synthetic
ARVKDGYDAFHI

SEQ ID NO: 1968 - protein, 108 aa, Artificial Sequence
  Synthetic
DIQMTQSPSTLSASVEDRVTITCRASQNINSWLAWYQQKPGKAPKLLIYDASSLESGVPSRFSGSGSGTEFTLTISSLQPDDFATYYCQQYKSYSPLTFGQGTKVEIK

SEQ ID NO: 1969 - protein, 10 aa, Artificial Sequence
  Synthetic
QQYKSYSPLT

SEQ ID NO: 1970 - protein, 124 aa, Artificial Sequence
  Synthetic
EVQLVQSGAEVKKPGESLRISCKGSGYSFTSYWISWVRQTPGRGLEWMGNIDPVDSNTNYSPSFQGHVTLSADKSISTAYLQWSSLKASDTAVYYCASQSGSVSQYYYYFMDVWGKGTTVTVSS

SEQ ID NO: 1971 - protein, 17 aa, Artificial Sequence
  Synthetic
ASQSGSVSQYYYYFMDV

SEQ ID NO: 1972 - protein, 107 aa, Artificial Sequence
  Synthetic
DIQMTQSPSSLSASVGDRVTITCRASQSISSYLNWYQQKPGKAPNLLIYAASSLQSGVPSRFSGSGSGTDFTLTISSLQPEDLATYYCQQSYTTQWTFGQGTKVEIK

SEQ ID NO: 1973 - protein, 9 aa, Artificial Sequence
  Synthetic
QQSYTTQWT

SEQ ID NO: 1974 - protein, 127 aa, Artificial Sequence
  Synthetic
QVQLVESGGGVVQPGRSLRLSCAASGFTFSSYAMHWVRQAPGKGLEWVAVISYDGNIKFYADSMKGRFTISRDNSKNTLYLQINSLRAEDTAVYYCARETWGDSGGFGSVVLYFDYWGQGTLVTVSS

SEQ ID NO: 1975 - protein, 20 aa, Artificial Sequence
  Synthetic
ARETWGDSGGFGSVVLYFDY

SEQ ID NO: 1976 - protein, 108 aa, Artificial Sequence
  Synthetic
DIQMTQSPSSLSASVGDRVTITCRASQSISSYLNWYQQKPGKAPKLLIYVASSLQSGVPSRFSGSGSGTDFTLTISSLQPEDFATYYCQQTYTTFELTFGGGTKVEIK

SEQ ID NO: 1977 - protein, 10 aa, Artificial Sequence
  Synthetic
QQTYTTFELT

SEQ ID NO: 1978 - protein, 120 aa, Artificial Sequence
  Synthetic
EVQLLESGGGLVQPGGSLRLSCAASGFTFNINAMSWVRQAPGKGLEWVSSISGTGGDTYYADSVKGRFTISRDNSKNTLYLQMNSLRAEDTAAYYCAKKYCGGDCPIEYWGQGTPVTVSS

SEQ ID NO: 1979 - protein, 13 aa, Artificial Sequence
  Synthetic
AKKYCGGDCPIEY

SEQ ID NO: 1980 - protein, 107 aa, Artificial Sequence
  Synthetic
DIQMTQSPSTLSASVGDRVTITCRASQSISSWLAWYQQKPGKAPKLLIYDASNLESGVPSRFSGSGSGTEFTLTISSLQPDDFATYYCQQYNSYSRTFGQGTRVEIK

SEQ ID NO: 1981 - protein, 9 aa, Artificial Sequence
  Synthetic
QQYNSYSRT

SEQ ID NO: 1982 - protein, 127 aa, Artificial Sequence
  Synthetic
QVQLVQSGAEVKKPGASVKVSCKASGYTFTSYAMHWVRQAPGQRLEWMGWINAGNGNTKYSQKFQGSVTITRDTSASIVYMELSSLRSEDTAVYYCARGSRHYDSSGYSGTEYFQYWGQGTLVTVSS

SEQ ID NO: 1983 - protein, 20 aa, Artificial Sequence
  Synthetic
ARGSRHYDSSGYSGTEYFQY

SEQ ID NO: 1984 - protein, 107 aa, Artificial Sequence
  Synthetic
DIQMTQSPSTLSASVGDRVTITCRASQSISRWLAWYQQKLGKAPKLLIYDASSLESGVPSRFSGSGSGTEFTLTISSLQPDDFATYYCQQYNSYSWTFGQGTKVEIK

SEQ ID NO: 1985 - protein, 9 aa, Artificial Sequence
  Synthetic
QQYNSYSWT

SEQ ID NO: 1986 - protein, 121 aa, Artificial Sequence
  Synthetic
EVQLVQSGAEVKKPGESLKISCKGSGYTFTNYWIAWVRQMPGKGLEWLGIIYAGDSDTRYSPSFQGQVSISADQSSSTVYLQWRRLKASDTAMYYCARGWGGYSYGYLDEWGQGTQVTVSS

SEQ ID NO: 1987 - protein, 14 aa, Artificial Sequence
  Synthetic
ARGWGGYSYGYLDE

SEQ ID NO: 1988 - protein, 113 aa, Artificial Sequence
  Synthetic
DIVMTQSPDSLAVSLGERATINCKSSQSVLYRSNNKNYLAWYQQKPGQPPKLLIYWASTRESGVPDRFSGSGSGTDFTLTISSLQAEDVAVYYCQQYYSTPPTFGQGTKVEIK

SEQ ID NO: 1989 - protein, 9 aa, Artificial Sequence
  Synthetic
QQYYSTPPT

SEQ ID NO: 1990 - protein, 120 aa, Artificial Sequence
  Synthetic
EVQLVESGGGLVQPGGSLRLSCAASGVTVSSNYMSWVRQAPGKGLEWVSIIYSGGSTFYADSVQGRFTISRDNSKNTLFLQMSSLRAEDTAVYYCARVNPIMLSDAFDIWGQGTMVTVSS

SEQ ID NO: 1991 - protein, 14 aa, Artificial Sequence
  Synthetic
ARVNPIMLSDAFDI

SEQ ID NO: 1992 - protein, 108 aa, Artificial Sequence
  Synthetic
DIQMTQSPSSLSASVGDRVTITCQASQDISNYLNWYQQKPGKAPKLLIYDASKLETGVSSRFSGGGSGTDFTFTISSLQPEDIATYYCQQYDNLPSFTFGPGTKVDIK

SEQ ID NO: 1993 - protein, 10 aa, Artificial Sequence
  Synthetic
QQYDNLPSFT

SEQ ID NO: 1994 - protein, 116 aa, Artificial Sequence
  Synthetic
EVQLVESGGGLIQPGGSLRLSCAASGFTVSSKYMSWVRQAPGKGLEWVSVIYSGGSTYYADSVKGRFTISRDDSKNTLYLQMNSLRAEDTAVYYCARDLTGGAGPWGQGTLVTVSS

SEQ ID NO: 1995 - protein, 10 aa, Artificial Sequence
  Synthetic
ARDLTGGAGP

SEQ ID NO: 1996 - protein, 107 aa, Artificial Sequence
  Synthetic
AIQMTQSPSSLSASVGDRVTITCRASQGIRNDLGWFQQKPGKAPKLLIYAASSLQSGVPSRFSGSGSGTDFTLTISSLQPEDFATYYCLQDYNYPRTFGQGTKVEIK

SEQ ID NO: 1997 - protein, 9 aa, Artificial Sequence
  Synthetic
LQDYNYPRT

SEQ ID NO: 1998 - protein, 121 aa, Artificial Sequence
  Synthetic
EVQLVESGGGLVQPGGSLRLSCAASGFTFSTYDMHWVRQGTGKGLEWVSAIGTAGDTYYSGSVKGRFTISRENAKNSFYLQMNSLRAGDTAVYYCARGTDTPMVNWYFDLWGRGTLVTVSS

SEQ ID NO: 1999 - protein, 15 aa, Artificial Sequence
  Synthetic
ARGTDTPMVNWYFDL

SEQ ID NO: 2000 - protein, 108 aa, Artificial Sequence
  Synthetic
DIQMTQSPSSLSASVGDRVTITCRASQSISRYLYWYQQKPGKAPKLLIYAASSLQSGVPSRFSGSGSGTDFTLTISSLQPEDFATYYCQQSYSMPPITFGQGTRLEIK

SEQ ID NO: 2001 - protein, 10 aa, Artificial Sequence
  Synthetic
QQSYSMPPIT

SEQ ID NO: 2002 - protein, 120 aa, Artificial Sequence
  Synthetic
EVQLLESGGGLVQPGGSLRLSCAASGFTFKYYAMSWVRQAPGKGLEWVSAIIGSGDNTYSAHSVKGRFTISRDNSKNTLYLQMNSLRAEDTAVYYCAKGSRSSSDYFDDWGQGTLVTVSS

SEQ ID NO: 2003 - protein, 12 aa, Artificial Sequence
  Synthetic
AKGSRSSSDYDD

SEQ ID NO: 2004 - protein, 107 aa, Artificial Sequence
  Synthetic
DIQMTQSPSTLSASVGDRVTITCRASQSISSWLAWYQQKPGKAPKLLIYDASSLETGVPSRFSGSGSGTEFTLTISSLQPDDFATYYCQQYNSYSPTFGQGTKVEIK

SEQ ID NO: 2005 - protein, 9 aa, Artificial Sequence
  Synthetic
QQYNSYSPT

SEQ ID NO: 2006 - protein, 124 aa, Artificial Sequence
  Synthetic
EVQLVESGGGLVQPGRSLRLSCAASGFTFDDYAMHWVRQAPGKGLEWVSGTTWNSGTIGYAGSVKGRFTVSRDNAKNSIYLQMNSLRVEDTALYYCAKGVVPGAIGYYSGMDVWGQGTTVTVSS

SEQ ID NO: 2007 - protein, 17 aa, Artificial Sequence
  Synthetic
AKGVVPGAIGYYSGMDV

SEQ ID NO: 2008 - protein, 107 aa, Artificial Sequence
  Synthetic
DIQMTQSPSSLSASVGDRVTITCRASQYISTYLNWYQQKPGKAPKLLIYTASSLQSGVPSRFSGSGSGTDFTLTIGNLQPEDFATYYCQQSYSTPRTFGQGTKLEIK

SEQ ID NO: 2009 - protein, 9 aa, Artificial Sequence
  Synthetic
QQSYSTPRT

SEQ ID NO: 2010 - protein, 131 aa, Artificial Sequence
  Synthetic
EVQLVESGGGLIQPGGSLRLSCAASGFTVSNNYMSWVRQAPGKGLEWVSVIYSGGSTYDADSVKGRFTISRDNSKNTLYLQMNSLSAEDTAVYYCAREGDVEGYYDFWSGYSRDRYYFDYWGQGTLVTVSS

SEQ ID NO: 2011 - protein, 25 aa, Artificial Sequence
  Synthetic
AREGDVEGYYDFWSGYSRDRYYFDY

SEQ ID NO: 2012 - protein, 101 aa, Artificial Sequence
  Synthetic
DIQMTQSPSSLSASVGDPSRASQSVSYLNRYHQKPGRAHKLLIYAASSLQRGVPSRFSGRGCGSDFSVTISSRQREVCASYYCQQSYSSPYSFGQGTTEIK

SEQ ID NO: 2013 - protein, 9 aa, Artificial Sequence
  Synthetic
QQSYSSPYS

SEQ ID NO: 2014 - protein, 124 aa, Artificial Sequence
  Synthetic
EVQLVESGGHLVKPGASLRLSCAASGFTFSNAWMSWVRQAPGKGLEWVGRIKSKADGGTTDYAAPVKGRFTISRDDSKNTLYLQMNSLKTEDTAVYYCSTDVWGFGEQWLLLEWGQGTLVTVSS

SEQ ID NO: 2015 - protein, 15 aa, Artificial Sequence
  Synthetic
STDVWGFGEQWLLLE

SEQ ID NO: 2016 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTTWTFGQGTKVEIK

SEQ ID NO: 2017 - protein, 9 aa, Artificial Sequence
  Synthetic
QQSYSTTWT

SEQ ID NO: 2018 - protein, 126 aa, Artificial Sequence
  Synthetic
EVQLVESGGGLVQPGGSLRLSCAASGFTFSNYWMTWVRQAPGKGLEWVANINQDGSEKYYVDSVKGRFTISRDNAKNSLYLQMNSLRAEDTAVYYCARDLVGYSGYEWQDNWFDPWGQGTLVTVSS

SEQ ID NO: 2019 - protein, 19 aa, Artificial Sequence
  Synthetic
ARDLVGYSGYEWQDNWFDP

SEQ ID NO: 2020 - protein, 108 aa, Artificial Sequence
  Synthetic
DIQMTQSPSTLSASVGDRVTITCRASQSINSWLAWYQQKPGKAPKVLIYDASSLESGVPSRFSGSGSETEFTLTISSLQPEDFATYYCQQYKSYSPITFGQGTRLEIK

SEQ ID NO: 2021 - protein, 10 aa, Artificial Sequence
  Synthetic
QQYKSYSPIT

SEQ ID NO: 2022 - protein, 120 aa, Artificial Sequence
  Synthetic
QVQLVESGGGLVKPGGSLRLSCAASGFTFSDYQMSWIRQAPGKGLEWVSYISHTHSFTNYADSVKGRFTISRDNAKNSLYLQMNSLRAEDTAVYYCVRDRGGSLPRFDYWGQGTLVTVSS

SEQ ID NO: 2023 - protein, 13 aa, Artificial Sequence
  Synthetic
VRDRGGSLPRFDY

SEQ ID NO: 2024 - protein, 106 aa, Artificial Sequence
  Synthetic
DIQMTQSPTLSASVGDRVTITCQASQDISNYLNWYQQKRGKAPKLLIYDASNLETGVPSRFSGSGSGTDFTFTISSLQPEDIATYYCQQYDNLPLTFGGGTKVEIK

SEQ ID NO: 2025 - protein, 9 aa, Artificial Sequence
  Synthetic
QQYDNLPLT

SEQ ID NO: 2026 - protein, 117 aa, Artificial Sequence
  Synthetic
QVQLVQSGAEVKKPGSSVKVSCKASGGTFSTDTISWVRQAPGRGLEWMGRIIPVFGVTNYAQKFQGRVTITADKSTTTAYMELSSLRSEDTALHYCARGASDAFDIWGQGTMVTVSS

SEQ ID NO: 2027 - protein, 10 aa, Artificial Sequence
  Synthetic
ARGASDAFDI

SEQ ID NO: 2028 - protein, 108 aa, Artificial Sequence
  Synthetic
DIQMTQSPSTLSASVGDRVTITCRASQTINSWLAWYQQKPGKTPKLLMYDASSLESGVPSRFSGSGSGTEFTLTISSLQPDDFGTYYFQQYKSYSPVTFGGGTKVEIK

SEQ ID NO: 2029 - protein, 10 aa, Artificial Sequence
  Synthetic
QQYKSYSPVT

SEQ ID NO: 2030 - protein, 123 aa, Artificial Sequence
  Synthetic
QVQLVESGGGVVQPGRSLRLSCAVSGFTFSSYGMHWVRQAPGKGLEWVAVFAYDGTNKYYADSVKGRFTISRDNSKNTLYLQMNNLRTEDTAVYYCAKDSARYSYGLDAFDIWGQGTLVTVSS

SEQ ID NO: 2031 - protein, 16 aa, Artificial Sequence
  Synthetic
AKDSARYSYGLDAFDI

SEQ ID NO: 2032 - protein, 107 aa, Artificial Sequence
  Synthetic
DIQMTQSPSSLSASVGDRVTITCRASQSINSFLNWYQQKPGKAPKLLIYAASSLQSGVPSRFSGSGSGTDFTLTISSLQPEDFATYYCQQSYITPRTFGPGTKVDIK

SEQ ID NO: 2033 - protein, 9 aa, Artificial Sequence
  Synthetic
QQSYITPRT

SEQ ID NO: 2034 - protein, 120 aa, Artificial Sequence
  Synthetic
EVQLLESGGGLVQPGGSLRLSCAASGFTFNRFAMNWVRQAPGKGLEWVSTIDGSGGNTYYADSVKGRFTISRDKSKSTLYLQMNSLRAEDTAVYYCAKEVFPGGYYMDVWGKGTTVTVSS

SEQ ID NO: 2035 - protein, 13 aa, Artificial Sequence
  Synthetic
AKEVFPGGYYMDV

SEQ ID NO: 2036 - protein, 107 aa, Artificial Sequence
  Synthetic
DIQMTQSPSTLSASVGDRVTVTCRASQSISSWLAWYQQKSGKAPKLLIYDASSLESGVPSRFSGSGLGTEFTLTISSLQPDDFATYYCQQYNSYFATFGQGTKVEIK

SEQ ID NO: 2037 - protein, 9 aa, Artificial Sequence
  Synthetic
QQYNSYFAT

SEQ ID NO: 2038 - protein, 126 aa, Artificial Sequence
  Synthetic
QVQLVESGGGVVQPGRSLRLSCAASGFIFSSYDMYWVRQAPDKRLEWVAVISSDGSGKFYADSVKGRYTISRDNSKNTLYLQLNSLTVEDTAVYYCAREPNYYDSSGYYYLFFDYWGQGTLVTVSS

SEQ ID NO: 2039 - protein, 19 aa, Artificial Sequence
  Synthetic
AREPNYYDSSGYYYLFFDY

SEQ ID NO: 2040 - protein, 108 aa, Artificial Sequence
  Synthetic
DIQMTQSPSSLSASVGDRVTITCRASQSIGMFLNWYQQKPGKAPKLLIYAASRLQSGVPSRFSGSGSGTDFTLSISSLQPDDFATYYCQQSYSTLALTFGGGTKVQIK

SEQ ID NO: 2041 - protein, 10 aa, Artificial Sequence
  Synthetic
QQSYSTLALT

SEQ ID NO: 2042 - protein, 126 aa, Artificial Sequence
  Synthetic
QVQLQESGPGLVKPSETLSLTCTVSGGSISRYYWSWIRQPPGKGLEWIGYIYYSGSTNYNPSFKSRVTISVDTSKNQFSLKLSSVTAADTAVYYCARHTLLHYYETSGPLWYFDLWGRGTLVSVSS

SEQ ID NO: 2043 - protein, 20 aa, Artificial Sequence
  Synthetic
ARHTLLHYYETSGPLWYFDL

SEQ ID NO: 2044 - protein, 107 aa, Artificial Sequence
  Synthetic
DIQMTQSPSSLSASVGDRVTITCRASQSISRYLNWYQQKPGKAPKPLIYAAFSLQSGVPSRFSGSGSGTDFTLTISSLQPEDFATYYCQQSYSTPWTFGQGTKVEIK

SEQ ID NO: 2045 - protein, 9 aa, Artificial Sequence
  Synthetic
QQSYSTPWT

SEQ ID NO: 2046 - protein, 120 aa, Artificial Sequence
  Synthetic
QVQLVESGGGVVQPGRSLRLSCAASGFTFSDYAMHWVRQAPGKGLEWLAAISSDGSIKYCVDSVKGRCTSSRDNSKNTLFLQMNSLRPEDTAVYYCARESSGYYTVFDFWGQGTLVIVSS

SEQ ID NO: 2047 - protein, 13 aa, Artificial Sequence
  Synthetic
ARESSGYYTVFDF

SEQ ID NO: 2048 - protein, 107 aa, Artificial Sequence
  Synthetic
DIQMTQSPSSLSASVGDRVTITCRASQSVNSYLNWYQQKPGNAPKLLIYAASSLQSGVPSRFSGSGSGTDFTLTISSLQPEDFATYYCQQSYTTLAFTFGGGTKVEI

SEQ ID NO: 2049 - protein, 10 aa, Artificial Sequence
  Synthetic
QQSYTTLAFT

SEQ ID NO: 2050 - protein, 121 aa, Artificial Sequence
  Synthetic
EVQLVESGGGLVQPGGSLRLSCSASGFMFSNYVMHWVRQAPGKGLEYVSAISSNGGITYYADSVKGRFTISRDNSKNTLFLQMSSLRPDDTAVYYCVKDFGIAVADIFDYWGQGTLVTVSS

SEQ ID NO: 2051 - protein, 14 aa, Artificial Sequence
  Synthetic
VKDFGIAVADIFDY

SEQ ID NO: 2052 - protein, 107 aa, Artificial Sequence
  Synthetic
DIQMTQSPVSLSASVGDRVTITCRAGQSIGSYLNWYQQKPGKAPNLLIYGASSLQSGVPSRFRGSGSGTDFTLTISSLQPEDFATYFCQQSYSTPRTFGQGTKVEIK

SEQ ID NO: 2053 - protein, 9 aa, Artificial Sequence
  Synthetic
QQSYSTPRT

SEQ ID NO: 2054 - protein, 120 aa, Artificial Sequence
  Synthetic
QVQLVESGGGVVRPGRSLRLSCAASGFTFSSYAMHWVRQAPGKGLEWVAVILYDGSYKDYADSVKGRYTISRDNSRNTLYLQMNSLRAEDTAVYYCARDEGEVVTHFDYWGQGTLVTVSS

SEQ ID NO: 2055 - protein, 13 aa, Artificial Sequence
  Synthetic
ARDEGEVVTHFDY

SEQ ID NO: 2056 - protein, 108 aa, Artificial Sequence
  Synthetic
DIQMTQSPSSLSASVGDRVTITCRASQSISNYLSWYQQKPGKAPKLLIYAASTLQSGVPSRFSGSGSGTDFTLTISSLQPEDFATYFCQQSYNTPPWTFGQGTKVEIK

SEQ ID NO: 2057 - protein, 10 aa, Artificial Sequence
  Synthetic
QQSYNTPPWT

SEQ ID NO: 2058 - protein, 122 aa, Artificial Sequence
  Synthetic
EVQLVESGGGLVQPGGSLRLSCAASGFTFSNYDMHWVRQGTGKRLEWLSVIGTAGDTYYPDSVKGRFTISRENAKNSLYLQMNSLRAGDTAVYYCARGGYDSSGLYSWFDPWGQGTLVIVSS

SEQ ID NO: 2059 - protein, 16 aa, Artificial Sequence
  Synthetic
ARGGYDSSGLYSWFDP

SEQ ID NO: 2060 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTIRSLQPEDFATYYCQQSYSTTGFTFGPGTKVDIK

SEQ ID NO: 2061 - protein, 10 aa, Artificial Sequence
  Synthetic
QQSYSTTGFT

SEQ ID NO: 2062 - protein, 120 aa, Artificial Sequence
  Synthetic
EVQLVQSGAEVKKPGESLRISCKGSGYIFTRYWISWVRQMPGKGLEWMGRIDPSDSYTNYSPSFQGHVTISPDKSISTVYLQWSSLKASDSAMYYCARHLCGGDCSPDFWGQGTLVTVSS

SEQ ID NO: 2063 - protein, 13 aa, Artificial Sequence
  Synthetic
ARHLCGGDCSPDF

SEQ ID NO: 2064 - protein, 107 aa, Artificial Sequence
  Synthetic
DIQMTQSPSTLSASVGDRVTITCRASQSISSWLAWYQQYPGKAPKLLIYDASNLESGVPSRFSGSGSGTEFTLTISSLQPNDFATYYCHQYNSYPSTFGQGTKLEIK

SEQ ID NO: 2065 - protein, 9 aa, Artificial Sequence
  Synthetic
HQYNSYPST

SEQ ID NO: 2066 - protein, 128 aa, Artificial Sequence
  Synthetic
QVQLVQSGAEVKKPGSSVRVSCKASGGTFNTYTISWVRQAPGQGLEWMGRIIPIAGKANYAQKFQGRVTITADKSTSTAYMELSSLRSEDTAVYYCARAALLTHAFESGDYPDAFGIWGQGTMVTVSS

SEQ ID NO: 2067 - protein, 21 aa, Artificial Sequence
  Synthetic
ARAALLTHAFESGDYPDAFGI

SEQ ID NO: 2068 - protein, 108 aa, Artificial Sequence
  Synthetic
DIQMTQSPSTLSASVGDRVTITCRASQSISSWLAWYQQKPGEAPKLLIYDASSLGSGVPSRFTGSGSGTEFTLTISSLQPDDFATYYCQQYNSYSPLTFGGGTKVEIK

SEQ ID NO: 2069 - protein, 10 aa, Artificial Sequence
  Synthetic
QQYNSYSPLT

SEQ ID NO: 2070 - protein, 123 aa, Artificial Sequence
  Synthetic
QVQLVQSGAEVKKPGSSVKVSCKASGGTFSSDSLSWVRQAPGQGLEWMGRIIPILAITNYAQQFQGRVTITADKSTSTAYMELSSLRSDDTAVYYCARTPFIVGTTRDAFDIWGQGTMVTVSS

SEQ ID NO: 2071 - protein, 16 aa, Artificial Sequence
  Synthetic
ARTPFIVGTTRDAFDI

SEQ ID NO: 2072 - protein, 108 aa, Artificial Sequence
  Synthetic
DIQMTQSPSTLSASVGDRVTITCRASQSINSWLAWYQQKPGKAPKLLIYDASSLESGVPSRFSGSGSGTEFTLTISSLQPDDFATYYCQQYKSYSPLTFGGGTKVEIK

SEQ ID NO: 2073 - protein, 10 aa, Artificial Sequence
  Synthetic
QQYKSYSPLT

SEQ ID NO: 2074 - protein, 123 aa, Artificial Sequence
  Synthetic
EVQLVESGGGLVQPGRSLRLSCAASGFTIDDYAMHWVRQAPGKGLEWVSGISWNSGTIDYADSVNGRFTISRDNAKNSLYLQMNSLRAEDTALYYCAKERGYCTNGLCGFDYWGQGTLVTVSS

SEQ ID NO: 2075 - protein, 16 aa, Artificial Sequence
  Synthetic
AKERGYCTNGLCGFDY

SEQ ID NO: 2076 - protein, 112 aa, Artificial Sequence
  Synthetic
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 2077 - protein, 9 aa, Artificial Sequence
  Synthetic
MQALQTPYT

SEQ ID NO: 2078 - protein, 117 aa, Artificial Sequence
  Synthetic
EVQLVESGGGLVQPGGSLRLSCAASGFPVSSNYMSWVRQAPGKGLEWVSVIYAGGSTFYAESVKGRFTISRDNSKNTLYLQMNSLRAEDTAVYYCARDRDYYGMDVWGQGTTVTVSS

SEQ ID NO: 2079 - protein, 11 aa, Artificial Sequence
  Synthetic
ARDRDYYGMDV

SEQ ID NO: 2080 - protein, 109 aa, Artificial Sequence
  Synthetic
AIQLTQSPSSLSASVGDRVTITCRASQGISNALAWFQQKPGKPPKLLIYGASSLESGVPSRFSGSGSGTDFTLTISSLQPDDFATYYCQQFNSDPHRFTFGPGTKVDIK

SEQ ID NO: 2081 - protein, 11 aa, Artificial Sequence
  Synthetic
QQFNSDPHRFT

SEQ ID NO: 2082 - protein, 123 aa, Artificial Sequence
  Synthetic
QMQLVQSGPEVKKPGTSVKVSCKASGFTFTTPSAVQWVRQARGQRLEWIGWIVVGSGNTNYAQKFQERVTITSDMSTSTAYMEVSSLRSEDTAVYFCAAVYCTTTCSDAFDIWGQGTMVTVSS

SEQ ID NO: 2083 - protein, 15 aa, Artificial Sequence
  Synthetic
AAVYCTTTCSDAFDI

SEQ ID NO: 2084 - protein, 108 aa, Artificial Sequence
  Synthetic
EIVLTQSPGTLSLSPGERATLSCRASESVRSTHLAWYQQKPGQAPRLLIYGASSRATGIPDRFSGSGSGTDFTLTISRLEPEDFAVYYCQQYDISPWTFGQGTKVEIK

SEQ ID NO: 2085 - protein, 9 aa, Artificial Sequence
  Synthetic
QQYDISPWT

SEQ ID NO: 2086 - protein, 129 aa, Artificial Sequence
  Synthetic
QVQLVQSGAEVKKPGSSVKVSCKASGGTFTNYAISWLRQAPGQGLEWMGKSIPFFDKVNYAQKFQGRVTIIADKSTSTGYMEMSNLRSEDTAVYYCAREEGRYYDSSGYDGDGFIRWDYWGQGTLVTVS

SEQ ID NO: 2087 - protein, 23 aa, Artificial Sequence
  Synthetic
AREEGRYYDSSGYDGDGFIRWDY

SEQ ID NO: 2088 - protein, 107 aa, Artificial Sequence
  Synthetic
DIQMTQSPSSLSASVGDRVTITCRASQSISSYVNWYQQKSGKAPKLLIYAASSLQSGVPSRFSGSGFGTDFTLTISSLQPEDFATYYCQLSYSSLFTFGPGTKVDIK

SEQ ID NO: 2089 - protein, 9 aa, Artificial Sequence
  Synthetic
QLSYSSLFT

SEQ ID NO: 2090 - protein, 124 aa, Artificial Sequence
  Synthetic
QVQLVQSGAEVKKPGSSVKVSCKGSGGTFGSYAISWVRQAPGQGLEWMGRIIAILGKPNYAQKFQGRVTITADTATSTAYMELSSLRSEDTAVYYCARHHHDVDKPMVNFFDYWGQGTLVTVSS

SEQ ID NO: 2091 - protein, 17 aa, Artificial Sequence
  Synthetic
ARHHHDVDKPMVNFFDY

SEQ ID NO: 2092 - protein, 107 aa, Artificial Sequence
  Synthetic
DIQMTQSPSTLSASVGDRLTITCRASQSINTWLAWYQQKPGKAPNLLIYDASSLQSGVPSRFSGSGSGTEFTLTISSLQPDDFATFYCQQYYNYPWTFGQGTRVDIK

SEQ ID NO: 2093 - protein, 9 aa, Artificial Sequence
  Synthetic
QQYYNYPWT

SEQ ID NO: 2094 - protein, 120 aa, Artificial Sequence
  Synthetic
EVQLLESGGGLVQPGGSLRLSCAVSGFIFSRYAMSWVRQAPGKGLEWVSAITGSGDSTYYAASVKGRFTISRDNSKNTLYLQMNSLRAEDTAVYYCAKDPRYNWNYADYWGQGTLVTVSS

SEQ ID NO: 2095 - protein, 13 aa, Artificial Sequence
  Synthetic
AKDPRYNWNYADY

SEQ ID NO: 2096 - protein, 107 aa, Artificial Sequence
  Synthetic
DIQMTQSPSTLSASVGDRVIITCRASQSISSWLAWYQQKPGKAPKLLIYDASSLESGVPSRFSGSGSGTEFTLTISSLQPDDFATYYCQQYNTYSYTFGQGTKLEIK

SEQ ID NO: 2097 - protein, 9 aa, Artificial Sequence
  Synthetic
QQYNTYSYT

SEQ ID NO: 2098 - protein, 127 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTMYVQMNSLRAEDTAVYYCAKQEGEYCSGGSCYSGNFDYWGQGTLVTVSS

SEQ ID NO: 2099 - protein, 20 aa, Artificial Sequence
  Synthetic
AKQEGEYCSGGSCYSGNFDY

SEQ ID NO: 2100 - protein, 107 aa, Artificial Sequence
  Synthetic
DIQMTQSPSSLSASVGDRVTITCQASQDIRNYLNWYQQKPGKAPKLLIYDASNLETGVPSRFSGSGSGTDFAFTISSLQPEDIATYHCQQYNNFPLTFGGGTKVEIK

SEQ ID NO: 2101 - protein, 9 aa, Artificial Sequence
  Synthetic
QQYNNFPLT

SEQ ID NO: 2102 - protein, 118 aa, Artificial Sequence
  Synthetic
EVQLVESGGGLVQPGGSLRLSCAASGLTVSSNYMNWVRQAPGKGLEWVSVIYSGGSTFYADSVKGRFTISRDNSNNTLYLQMNSLRAEDTAVYYCARDRAHYYGMDVWGQGTTVTVSS

SEQ ID NO: 2103 - protein, 12 aa, Artificial Sequence
  Synthetic
ARDRAHYYGMDV

SEQ ID NO: 2104 - protein, 106 aa, Artificial Sequence
  Synthetic
DIQLTQSPVTLSASVGDRVTITCRASQGISTYLAWYQQKPGKAPKLLIYAASTLQSGVPSRFSGSGSGTEFTLTISSLQPEDFATYYCQELNSDPTFGGGTKVEIK

SEQ ID NO: 2105 - protein, 8 aa, Artificial Sequence
  Synthetic
QELNSDPT

SEQ ID NO: 2106 - protein, 122 aa, Artificial Sequence
  Synthetic
EVQLLESGGGLVQPGGSLRVSCAASGFTFSSYAMSWVRQAPGKGLEWVSGISASGDIRDYADAVKGRFTISRDNSKNTLYLQMNSLRAEDTAVYYCAKDYGITMIVDLLDHWGQGTLVTVSS

SEQ ID NO: 2107 - protein, 15 aa, Artificial Sequence
  Synthetic
AKDYGITMIVDLLDH

SEQ ID NO: 2108 - protein, 107 aa, Artificial Sequence
  Synthetic
DIQMTQSPSSLSASVGDRVTITCRASQSISAYLNWYQQKPGKAPKLLIYATSSLQSGVPSRFSGSGSGSDFTLTISSLQPEDFATYYCQQSYSTPLTFGGGTKVEIK

SEQ ID NO: 2109 - protein, 9 aa, Artificial Sequence
  Synthetic
QQSYSTPLT

SEQ ID NO: 2110 - protein, 125 aa, Artificial Sequence
  Synthetic
QVQLVQSGAEVKKPGASVKVSCKASGYSFTTHAMHWVRQTPGQRLEWMGWIDAGNGDTKYSQKFQGRVTITRDTSANTAYMELRSLRSEDTAVYYCARDPPSYHYGSGSYMFDYWGQGTQVTVSS

SEQ ID NO: 2111 - protein, 18 aa, Artificial Sequence
  Synthetic
ARDPPSYHYGSGSYMFDY

SEQ ID NO: 2112 - protein, 108 aa, Artificial Sequence
  Synthetic
EIVLTQSPGTLSLSPGERATLSCRASQSFGGSYLAWYQQKPGQAPRLLIYGASIRATGIADRFSGGGSGTDFTLTISRLEPEDFAVYYCQQYGSSPLTFGQGTKVEIK

SEQ ID NO: 2113 - protein, 9 aa, Artificial Sequence
  Synthetic
QQYGSSPLT

SEQ ID NO: 2114 - protein, 124 aa, Artificial Sequence
  Synthetic
QVQLVESGGGVVQPGRSLRLPCAASGFTFSTYGMHWVRQAPGKGLEWVALISYDGSNKYYADSVKGRFTISRDNSKNTLYLQMNSLKTEDTAVYYCAKNSGSYFAANTYLLDYWGQGTLVTVSS

SEQ ID NO: 2115 - protein, 17 aa, Artificial Sequence
  Synthetic
AKNSGSYFAANTYLLDY

SEQ ID NO: 2116 - protein, 107 aa, Artificial Sequence
  Synthetic
DIQMTQSPSTLFAFVGDRVTITCRASQSISSWLAWYQQKPGKAPKVLIYDASSLESGVPSRFSGSGFGTEFTFTISSLQPDDFATYYCQQYTSLPLTFGGGTKVQIK

SEQ ID NO: 2117 - protein, 9 aa, Artificial Sequence
  Synthetic
QQYTSLPLT

SEQ ID NO: 2118 - protein, 123 aa, Artificial Sequence
  Synthetic
EVQLLESGGGLVQPGGSLRLSCAPSGFTFSSYAMSWVRQAPGKGLEWVSGISGSGGSTYYADSVKGRFTISRDNSKNTLYLRLNSLRAEDTAVYYCAKHGFGYDYWSGYFDYWGQGTLVTVSS

SEQ ID NO: 2119 - protein, 16 aa, Artificial Sequence
  Synthetic
AKHGFGYDYWSGYFDY

SEQ ID NO: 2120 - protein, 108 aa, Artificial Sequence
  Synthetic
DIQMTQSPSSLSASVGDRVTITCQASQDISNYLNWYQQKPGKAPKLLIYDASNLETGVPSRFSGSGSGTDFTFTISRLQPEDIATYYCQQYANLPPYTFGQGTKLEIK

SEQ ID NO: 2121 - protein, 10 aa, Artificial Sequence
  Synthetic
QQYANLPPYT

SEQ ID NO: 2122 - protein, 122 aa, Artificial Sequence
  Synthetic
QVQLVESGGGVVQPGRSLRLSCAASGFTFSTYGMHWVRQAPGKGLEWVAVISYDGSNKYYADSVKGRFTISRDNSKNTLYLQMNSLRAEDTAVYYCAKGGGRYYYPSPPDYWGQGTPVTVSS

SEQ ID NO: 2123 - protein, 15 aa, Artificial Sequence
  Synthetic
AKGGGRYYYPSPPDY

SEQ ID NO: 2124 - protein, 107 aa, Artificial Sequence
  Synthetic
DIQMTQSPSSLSASVGDRVTITCQASQGISYYLNWYQQQPGKAPKLLIYDASSLETGVPSRFSGSGSGTDFTFTISSLQPEDIATYYCQQYHNLPFTFGQGTKLEIK

SEQ ID NO: 2125 - protein, 9 aa, Artificial Sequence
  Synthetic
QQYHNLPFT

SEQ ID NO: 2126 - protein, 118 aa, Artificial Sequence
  Synthetic
EVQLVESGGGLIQPGGSLRLSCAASGFIVSRNYMSWVRQAPGKGLEWVSIIYSGGSTYYADSVKGRFTISRDNSKNTLYLQMNSLRAEDTAVYSCARDRSTRGAFDIWGQGTMVTVSS

SEQ ID NO: 2127 - protein, 12 aa, Artificial Sequence
  Synthetic
ARDRSTRGAFDI

SEQ ID NO: 2128 - protein, 107 aa, Artificial Sequence
  Synthetic
DIQMTQSPSSLSASVGDRVTITCQASQDINIYLNWFQQKPGKAPKLLIYDASNLETGVPSRFSGSGSGTDFTFTISSLQPEDIATYYCQQYDNLPPAFGPGTKVDIK

SEQ ID NO: 2129 - protein, 9 aa, Artificial Sequence
  Synthetic
QQYDNLPPA

SEQ ID NO: 2130 - protein, 120 aa, Artificial Sequence; identical to SEQ ID NO: 1990
  Synthetic

SEQ ID NO: 2131 - protein, 14 aa, Artificial Sequence
  Synthetic
ARVNPIMLSDAFDI

SEQ ID NO: 2132 - protein, 108 aa, Artificial Sequence; identical to SEQ ID NO: 1992
  Synthetic

SEQ ID NO: 2133 - protein, 10 aa, Artificial Sequence
  Synthetic
QQYDNLPSFT

SEQ ID NO: 2134 - protein, 124 aa, Artificial Sequence
  Synthetic
QVQLVQSGAEVKKPGSSVKVSCKASGGTFSTYVISWVRQAPGQGLEWMGRIIPMVPIANYAQKFQGRVTITADKSTSTAYMELSSLRSEDTAVYYCAGAGIAAGGTLGDAFHIWGQGTMVTVSS

SEQ ID NO: 2135 - protein, 17 aa, Artificial Sequence
  Synthetic
AGAGIAAGGTLGDAFHI

SEQ ID NO: 2136 - protein, 108 aa, Artificial Sequence
  Synthetic
DIQMTQSPSTLSASVGDRVTITCRASQSLSSWLAWYQQKPGKAPKLLIYDASSLESGVPSRFSGSGSGTEFTLTISSLQPDDFATYYCQQYNSYSPVTFGGGTKVEIK

SEQ ID NO: 2137 - protein, 10 aa, Artificial Sequence
  Synthetic
QQYNSYSPVT

SEQ ID NO: 2138 - protein, 118 aa, Artificial Sequence
  Synthetic
EVQLVESGGGLVQPGGSLRLSCAASGFNVSTNYMSWVRQAPGKGLEWVSVIYTDGSTYSAASVKGRFTISRDNSQNTLYLQMNSLRAEDTAVYYCARVSRGFYYLGYWGQGTLVTVSS

SEQ ID NO: 2139 - protein, 12 aa, Artificial Sequence
  Synthetic
ARVSRGFYYLGY

SEQ ID NO: 2140 - protein, 108 aa, Artificial Sequence
  Synthetic
EIVLTQSPGTLSLSPGERATLSCRASQGVSNNFLAWYQQKPGQAPRLLIYGASRRATGIPDRFSGSGSGTDFSLTISRLEPEDFAVYYCQQYGSSLYTFGQGTKLEIK

SEQ ID NO: 2141 - protein, 9 aa, Artificial Sequence
  Synthetic
QQYGSSLYT

SEQ ID NO: 2142 - protein, 123 aa, Artificial Sequence
  Synthetic
EVQLVESGGGLVQPGRSLRLSCAASGFTFDDYAIHWVRQAPGKGLEWVSGISWNSGTRAYAVSVNGRFTISRDNAKNSLYLQMNSLRAEDTALYYCAKVTTVTRFLFGAFDIWGQGTMVTVSS

SEQ ID NO: 2143 - protein, 16 aa, Artificial Sequence
  Synthetic
AKVTTVTRFLFGAFDI

SEQ ID NO: 2144 - protein, 107 aa, Artificial Sequence
  Synthetic
EIVMTQSPATLSVSPGERATLSCRASQSLSSNLAWYQQKPGQGPRLLIYGASTRATGVPARFSGSGSGTEFTLTISSLQSEDFAVYYCQHYNNWPPSFGPGTKVDIK

SEQ ID NO: 2145 - protein, 9 aa, Artificial Sequence
  Synthetic
QHYNNWPPS

SEQ ID NO: 2146 - protein, 119 aa, Artificial Sequence
  Synthetic
QVQLVQSGAEVKRPGSSVKVSCKASGGTFSLSSINWVRQAPGQGLEWMGRVIPILGITTYAQKLQDRVTMTADKSTSTAYMELSSLRSEDTAVYYCARGERDGSRFDPWGQGTLVTVSS

SEQ ID NO: 2147 - protein, 12 aa, Artificial Sequence
  Synthetic
ARGERDGSRFDP

SEQ ID NO: 2148 - protein, 107 aa, Artificial Sequence
  Synthetic
DIQMTQSPSTLSASVGDRVTITCRASQSINSWLAWYRQKPGKAPKLLIYDASSLESGVPSRFSGSGSGTEFTLTISSLQPDDFATYYCQQYHSSFLTFGGGTKVEIK

SEQ ID NO: 2149 - protein, 9 aa, Artificial Sequence
  Synthetic
QQYHSSFLT

SEQ ID NO: 2150 - protein, 118 aa, Artificial Sequence
  Synthetic
EVQLVESGGGLVQPGGSLRLSCAASGITVRSNYMSWVRQAPGKGLEWVSVIYSGSSSFYADSVKGRFTISRDNTKNTLYLQMNSLRAEDTAVYHCARDLQAAGGMDVWGQGTTVTVSS

SEQ ID NO: 2151 - protein, 12 aa, Artificial Sequence
  Synthetic
ARDLQAAGGMDV

SEQ ID NO: 2152 - protein, 107 aa, Artificial Sequence
  Synthetic
DIQLTQSPSFLSASVGDRVTITCRASQGISSYLAWYQQKPEKAPKLLIYAASTLQSGVPSRFSGSGSGTDFTLTISSLQPEDFATYYCQHLNGYPLTFGQGTKLEIK

SEQ ID NO: 2153 - protein, 9 aa, Artificial Sequence
  Synthetic
QHLNGYPLT

SEQ ID NO: 2154 - protein, 127 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNSLYLQMNGLRAEDTAVYYCVKTNSPYCGGGSCYNGVFEYWGQGTLVTVSS

SEQ ID NO: 2155 - protein, 20 aa, Artificial Sequence
  Synthetic
VKTNSPYCGGGSCYNGVFEY

SEQ ID NO: 2156 - protein, 108 aa, Artificial Sequence
  Synthetic
DIQMTQSPSSLSASVGDRVTITCQASQDISNYLHWYQQKPGKAPKLLIYDASNLETGVPSRFSGSGSGTDFTFTISSLQPEDIATYYCQQYDNLPPWTFGQGTKVEIK

SEQ ID NO: 2157 - protein, 10 aa, Artificial Sequence
  Synthetic
QQYDNLPPWT

SEQ ID NO: 2158 - protein, 122 aa, Artificial Sequence
  Synthetic
EVQLVESGGGLVQPGGSLRLSCAASGFTFSNYDMHWVRQVTGKGLEWVSVIGTAGDTYYPDSVKGRFTISRENAKNSLYLQMNSLRAGDTAVYYCARGGYDSSGLHSWFDPWGQGTLVTVSS

SEQ ID NO: 2159 - protein, 16 aa, Artificial Sequence
  Synthetic
ARGGYDSSGLHSWFDP

SEQ ID NO: 2160 - protein, 108 aa, Artificial Sequence
  Synthetic
DIQMTQSPSSLSASVGDRVTITCRASQSITSYLNWYQQKPGKAPKLLIYAASSLQSGVPSRFSGSGSGTDFTLTITSLQPEDFATYYCQQSYVTTGFTFGPGTKVDIK

SEQ ID NO: 2161 - protein, 10 aa, Artificial Sequence
  Synthetic
QQSYVTTGFT

SEQ ID NO: 2162 - protein, 120 aa, Artificial Sequence
  Synthetic
QVQLQESGPGLVKPSGTLSLTCAVSGGSIRSSTWWSWVRQPPGKGLEWIGEVYHSGDTNYNPSLKSRVAISVDKSKNQFSLKLSSVTAADTAVYYCARRVVGASGDFDYWGQGTLVTVSS

SEQ ID NO: 2163 - protein, 13 aa, Artificial Sequence
  Synthetic
ARRVVGASGDFDY

SEQ ID NO: 2164 - protein, 103 aa, Artificial Sequence
  Synthetic
EIVLTQSPATLSLSPGERATLSCRASQSVTNYLAWYQQKSGQAPRLLIYDASNRATGIPARFSGSGSGTDFTLTISSLEPEDFAVYYCQMSSLFGGGAKVEIK

SEQ ID NO: 2165 - protein, 5 aa, Artificial Sequence
  Synthetic
QMSSL

SEQ ID NO: 2166 - protein, 124 aa, Artificial Sequence
  Synthetic
EVQLVESGGGLVQPGGSLRLSCAASGFTISSDDMHWVRQTAGKGLEWVSAIGTAGDTYYPGSVKGRFTISRENAKNSLSLQMNSLRAGDTGVYFCARGSAVTTPYAHYYIMDVWGQGTTVTVSS

SEQ ID NO: 2167 - protein, 18 aa, Artificial Sequence
  Synthetic
ARGSAVTTPYAHYYIMDV

SEQ ID NO: 2168 - protein, 108 aa, Artificial Sequence
  Synthetic
DIQMTQSPSSLSASVGDRVTITCRASQSISRYLNWYQQKPGKAPKLLIYAASSLQSGVPSRFSGSGSGTDFTLTISSLQPEDLATYYCQQSYSSPPWTFGQGTKVEIK

SEQ ID NO: 2169 - protein, 10 aa, Artificial Sequence
  Synthetic
QQSYSSPPWT

SEQ ID NO: 2170 - protein, 120 aa, Artificial Sequence
  Synthetic
EVQLLESGGGLVQPGGSLRLSCAASGFTFGSYAMSWVRQAPGKGLESVSAISGSSSSTYYADSVKGRFTISRDNSKNTLYLQMNSLRAEDTAVYYCAKGSRYNWDYFDFWGQGTLVSVSS

SEQ ID NO: 2171 - protein, 13 aa, Artificial Sequence
  Synthetic
AKGSRYNWDYFDF

SEQ ID NO: 2172 - protein, 107 aa, Artificial Sequence
  Synthetic
DIQMTQSPSTLSASVGDRVTITCRASQSIRSWLAWYQQKPGKAPKLLIYDASSLESGVPSRFSGSGSGTEFTLTISSLQPDDFATYYCQQFNSNPWTFGQGTKVEIK

SEQ ID NO: 2173 - protein, 9 aa, Artificial Sequence
  Synthetic
QQFNSNPWT

SEQ ID NO: 2174 - protein, 129 aa, Artificial Sequence
  Synthetic
QVQLVESGGGLVKPGGSLRLSCAASGFTFSDYYMSWIRQAPGKGLEWVSYISNSGSTLYYADSVKGRFTISRDNAKNSLFLQMNSLRAEDTAVYYCARYRRHPYYDFLTGYSEYGMDVWGQGTTVTVSS

SEQ ID NO: 2175 - protein, 22 aa, Artificial Sequence
  Synthetic
ARYRRHPYYDFLTGYSEYGMDV

SEQ ID NO: 2176 - protein, 111 aa, Artificial Sequence
  Synthetic
DIVMTQSPLSLPVTPGEPASISCRSSQSLLHSNGENYLDWYLQKPGQSPQLLIYLGSNRASGVPDRFSGSGSGTDFTLKISRVEAEDVGVYYCMQTLQTPTFGQGTKVEIK

SEQ ID NO: 2177 - protein, 8 aa, Artificial Sequence
  Synthetic
MQTLQTPT

SEQ ID NO: 2178 - protein, 126 aa, Artificial Sequence
  Synthetic
QVQLVESGGGVVQPGRSLRLSCAASGFTFNHYGMHWVRQAPGKGLEWVAVISYDGSDKYYADSVKGRFTISRDNSKNTLYLQMNSLRAEDTAVYYCAKNLYSYAYPTPAGGTFDYWGQGTLVTVSS

SEQ ID NO: 2179 - protein, 19 aa, Artificial Sequence
  Synthetic
AKNLYSYAYPTPAGGTFDY

SEQ ID NO: 2180 - protein, 106 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIGTYYCQQYDNLPRFGQGTKLEIK

SEQ ID NO: 2181 - protein, 8 aa, Artificial Sequence
  Synthetic
QQYDNLPR

SEQ ID NO: 2182 - protein, 122 aa, Artificial Sequence
  Synthetic
QVQLVESGGGVVQPGRSLRLSCAASGFPFSSYGMHWVRQAPGKGLEWVAVISYDGSNKQYVDSVKGRFTISRDNSNNTLYLQMNSLRAEDTALYYCARDDYKYAYYYYMDVWGKGTTVTVSS

SEQ ID NO: 2183 - protein, 15 aa, Artificial Sequence
  Synthetic
ARDDYKYAYYYYMDV

SEQ ID NO: 2184 - protein, 107 aa, Artificial Sequence
  Synthetic
DIQMTQSPSSLSASVGDRVTITCRASQSIGSYLNWYQQKPPKAPKPLIYAASSLESGVSSRFSGSGSGTDFTLTISSLQPEDFATYYCQQSYSTPHTFGQGTKLEIK

SEQ ID NO: 2185 - protein, 9 aa, Artificial Sequence
  Synthetic
QQSYSTPHT

SEQ ID NO: 2186 - protein, 120 aa, Artificial Sequence
  Synthetic
QVQLVESGGGVVQPGRSLRLSCAASGFSFRSYGMHWVRQAPGKGLEWVAVIWSDGSGKHYADPVKGRFTISRDNPKNTLYLQMNSLRAEDTAVYYCARDEGEVVTHFDYWGQGTLVTVSS

SEQ ID NO: 2187 - protein, 13 aa, Artificial Sequence
  Synthetic
ARDEGEVVTHFDY

SEQ ID NO: 2188 - protein, 108 aa, Artificial Sequence
  Synthetic
DIQMTQSPSSLSASVGDRVTITCRASQSIRSYLNWYQQKPGKAPKLVIYGASSLQSGVPSRFSGSGSGTDFTLTISSLQPEDFATYYCQQSYNTPPWTFGQGTKVEIK

SEQ ID NO: 2189 - protein, 10 aa, Artificial Sequence
  Synthetic
QQSYNTPPWT

SEQ ID NO: 2190 - protein, 120 aa, Artificial Sequence
  Synthetic
EVQLLESGGGLVQPGGSLRLSCAASAFIFSRYAMSWVRQAPGKGLEWVSGISGSGDNTYYADSVKGRFTISRDNSKNILYLQMNSLRAEDTAVYYCAKDVRWSIDYFDYWGQGTLVTVSS

SEQ ID NO: 2191 - protein, 13 aa, Artificial Sequence
  Synthetic
AKDVRWSIDYFDY

SEQ ID NO: 2192 - protein, 107 aa, Artificial Sequence
  Synthetic
DIQMTQSPSTLSASVGDRVTITCRASQSISSWLAWYQQKPGKAPKLLIYDASNLESGVPSRFSGSGSGTEFTLTISSLQPDDFATYYCQQYNNYSWTFGQGTKVEIK

SEQ ID NO: 2193 - protein, 9 aa, Artificial Sequence
  Synthetic
QQYNNYSWT

SEQ ID NO: 2194 - protein, 123 aa, Artificial Sequence
  Synthetic
QVQLVESGGGVVQPGRSLRLSCAASGFTFRSYAMHWVRQAPGKGLEWEASISNDGSNKFYADSVKGRFTISRDNSKNTLYLQMNSLRAEDTAVYYCARELPIEYSTSSDFDYWGQGTLVTVSS

SEQ ID NO: 2195 - protein, 16 aa, Artificial Sequence
  Synthetic
ARELPIEYSTSSDFDY

SEQ ID NO: 2196 - protein, 107 aa, Artificial Sequence
  Synthetic
DIQMTQSPVLSASVGDRVTITCRASQSISRYLNWYQHKPGKAPKLLIYAASSLQSGVPSRFSGSGSGTDFTLTISSLQPEDFATYYCQQSYSTPQVTFGQGTRLEIK

SEQ ID NO: 2197 - protein, 10 aa, Artificial Sequence
  Synthetic
QQSYSTPQVT

SEQ ID NO: 2198 - protein, 120 aa, Artificial Sequence
  Synthetic
EVQLLESGGGLVQPGGSLRLSCAASGFTFSTYAMSWVRQAPGKGPEWVSGISGSGGSTYYADSVKVRFTISKDTSKNMLFLQMNSLRAEDTAVYYCAKGPRGSEDYFESWGRGTLVTVSS

SEQ ID NO: 2199 - protein, 13 aa, Artificial Sequence
  Synthetic
AKGPRGSEDYFES

SEQ ID NO: 2200 - protein, 107 aa, Artificial Sequence
  Synthetic
DIQMTQSPSTLSASVGDRVTITCRASQSISSWMAWYQQKPGKAPKLLIYDVSNLESGVPSRFSGSGSGTEFTLTISSLQPDDFATYYCQQYNRYPYTFGQGTKLEIK

SEQ ID NO: 2201 - protein, 9 aa, Artificial Sequence
  Synthetic
QQYNRYPYT

SEQ ID NO: 2202 - protein, 120 aa, Artificial Sequence
  Synthetic
EVQLLESGGGLVQPGGSLRLSCPASGFMFSRYAMSWVRQAPGKGLEWVSAISGSGGGTYYAGSVKGRFTISRDNSKNTLYLQMNSLRAEDTAVYYCAKDVRGSPDYMDVWGKGTTVTVSS

SEQ ID NO: 2203 - protein, 13 aa, Artificial Sequence
  Synthetic
AKDVRGSPDYMDV

SEQ ID NO: 2204 - protein, 107 aa, Artificial Sequence
  Synthetic
DIQMTQSPSTLSASVGDRVTITCRASQSIGSWLAWYQQKPGKAPKLLIYDASSLESGVPSTFSGSGSGTEFTLTISSLQPDDFATYYCQQYNSYPYTFGQGTKLEIK

SEQ ID NO: 2205 - protein, 9 aa, Artificial Sequence
  Synthetic
QQYNSYPYT

SEQ ID NO: 2206 - protein, 124 aa, Artificial Sequence
  Synthetic
EVQLVESGGGLVQPGGSLRLSCAASGFTFSSYWMNWVRQAPGKGLEWVANIKQDGSEKDYVGSLKGRFTISRDNAKNSLYLQMTSLRAEDTAVYYCARSHTLYSRFPLYYMDVWGKGTTVTVSS

SEQ ID NO: 2207 - protein, 17 aa, Artificial Sequence
  Synthetic
ARSHTLYSRFPLYYMDV

SEQ ID NO: 2208 - protein, 107 aa, Artificial Sequence
  Synthetic
DIQMTQSPSTLSASVGDRVTITCRASLSIIRWLAWFQQKPGKAPKLLIYDASSLESGVPSRFSGSGSGTEFTLTISSLQPEDFATYYCQQYNTYPWTFGQGTKVEVK

SEQ ID NO: 2209 - protein, 9 aa, Artificial Sequence
  Synthetic
QQYNTYPWT

SEQ ID NO: 2210 - protein, 122 aa, Artificial Sequence
  Synthetic
QLQLQESGPGLVKPSETLSLTCTVSGGSISSSSYYWVWIRQPPGKGLEWIGNIYYSGSTYYNPSLKSRVTISVDTSKNQFSLKLSSVTAADTAVYYCARFSRYYGTNWFDPWGQGTLVTVSS

SEQ ID NO: 2211 - protein, 14 aa, Artificial Sequence
  Synthetic
ARFSRYYGTNWFDP

SEQ ID NO: 2212 - protein, 110 aa, Artificial Sequence
  Synthetic
QSVLTQPPSASGSPGQSVTISCTGTSSDVGGYDYVSWYQQHPGKAPKLMIYEVSKRPSGVPDRFSGSKSGNTASLTVSGLQAEDEADYYCFSYAGSSNLLFGGGTKLTVL

SEQ ID NO: 2213 - protein, 10 aa, Artificial Sequence
  Synthetic
FSYAGSSNLL

SEQ ID NO: 2214 - protein, 125 aa, Artificial Sequence
  Synthetic
QVQLVQSGSELKKPGASVKVSCKASGYTFTSYTMIWVRQAPGQGLEWMGWINTNTGNPTYAQGFTGRFVFSLDTSVSTAYLQISSLKAEDTAVYYCARDAEVARFGDLWGGMDVWGQGTTVTVSS

SEQ ID NO: 2215 - protein, 18 aa, Artificial Sequence
  Synthetic
ARDAEVARFGDLWGGMDV

SEQ ID NO: 2216 - protein, 110 aa, Artificial Sequence
  Synthetic
QSVLTQEPSLTVSPGGTVTLTCGSSTGAVTNGHFPYWFQQKPGQAPRTLIYDTNNKHSWTPARFSGSLLGGKAALTLSGAQPADEAEYYCLLSYSGARRVFGGGTKLTVL

SEQ ID NO: 2217 - protein, 10 aa, Artificial Sequence
  Synthetic
LLSYSGARRV

SEQ ID NO: 2218 - protein, 125 aa, Artificial Sequence
  Synthetic
QVQLQESGPGLVKPSETLSLTCTVSGGSISSYYWSWIRQPPGKGLEWIGYIYNSGSTNYNPSLKSRVNISVDTSKNQFSLKLSSVTAADTAVYYCARLFPITMVRGVMHWYFDLWGRGTLVTVSS

SEQ ID NO: 2219 - protein, 19 aa, Artificial Sequence
  Synthetic
ARLFPITMVRGVMHWYFDL

SEQ ID NO: 2220 - protein, 110 aa, Artificial Sequence
  Synthetic
QSVLTQPPSASGTPGQRVTISCSGRSSNIGSNNVYWYQQLPGTAPKLLIYRNNQRPSGVPDRFSGSKSGTSASLAISGLRSEDEADYYCAAWDDSLSGPVFGGGTKLTVL

SEQ ID NO: 2221 - protein, 11 aa, Artificial Sequence
  Synthetic
AAWDDSLSGPV

SEQ ID NO: 2222 - protein, 121 aa, Artificial Sequence
  Synthetic
QVQLVQSGAEVKKPGASVKVSCKASAYSFTNYYMYWVRQAPGQGLEWMGIINPSGGSTTYAQNFQGRVTMTRETSTSTVYMELSSLRSEDTAVYYCASSPSDILTGYIHYWGQGTLVTVSS

SEQ ID NO: 2223 - protein, 14 aa, Artificial Sequence
  Synthetic
ASSPSDILTGYIHY

SEQ ID NO: 2224 - protein, 108 aa, Artificial Sequence
  Synthetic
SYVLTQPPSVSVAPGKTARITCGGSDIGSKNVHWYQQKPGQAPILVVYDDSDRPSGIPERFSGSNSGNTATLTVSRVEAGDEADYYCQVWDSSPDHWVFGGGTKLTVL

SEQ ID NO: 2225 - protein, 11 aa, Artificial Sequence
  Synthetic
QVWDSSPDHWV

SEQ ID NO: 2226 - protein, 125 aa, Artificial Sequence
  Synthetic
EVQLVESGGDLVQPGGSLRLSCAASGFSFSGYEMNWVRQAPGKGLEWVSHISSSGSTIYSADSVKGRFTISRDNAKNSLYLQMNSLRAEDTAVYYCARELPRGYYDTSGYRLDSWGQGTLVTVSS

SEQ ID NO: 2227 - protein, 18 aa, Artificial Sequence
  Synthetic
ARELPRGYYDTSGYRLDS

SEQ ID NO: 2228 - protein, 112 aa, Artificial Sequence
  Synthetic
QSVLTQPASVSGSPGQSITISCTGTSSDVGGYNYVSWYQQHPGKAPKLMIYDVSNRPSGVSNRFSGSKSGNTASLTISGLQAEDEADYYCSSYTNYNTLLYVFGTGTKVTVL

SEQ ID NO: 2229 - protein, 12 aa, Artificial Sequence
  Synthetic
SSYTNYNTLLYV

SEQ ID NO: 2230 - protein, 122 aa, Artificial Sequence
  Synthetic
QVQLVQSGAEVKKPGASVKVSCKASGYTFTNYYMHWVRQAPGQGLEWMGIINPSGGSTSYAQQFQGRVTMTRDTSTSTVYMELSSLRSEDTAVYYCARGGIVPAHTMPFDYWGQGTLVTVSS

SEQ ID NO: 2231 - protein, 15 aa, Artificial Sequence
  Synthetic
ARGGIVPAHTMPFDY

SEQ ID NO: 2232 - protein, 110 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGAWDSSLSTWVFGGGTKLTVL

SEQ ID NO: 2233 - protein, 11 aa, Artificial Sequence
  Synthetic
GAWDSSLSTWV

SEQ ID NO: 2234 - protein, 119 aa, Artificial Sequence
  Synthetic
EVQLVQSGAEVKKPGESLRISCKGSGDSFTSYWINWVRQMPGKGLEWMGRIDLSDSSTNYSPSFQGHVTISADKSISTAYLQWSSLKASDTAKYYCARLKWLRGDFDYWGQGTLVTVSS

SEQ ID NO: 2235 - protein, 12 aa, Artificial Sequence
  Synthetic
ARLKWLRGDFDY

SEQ ID NO: 2236 - protein, 110 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLRTEDEADYYCQSYDSNNQVFGGGTKLTVL

SEQ ID NO: 2237 - protein, 9 aa, Artificial Sequence
  Synthetic
QSYDSNNQV

SEQ ID NO: 2238 - protein, 124 aa, Artificial Sequence
  Synthetic
EVQLLESGGGLVQPGGSRLSCAASGFTFSSYAMSWVRQAPGKGLEWVSTISGSGGSTYYADSVKGRSTISRDNSKNTLYLQMNSLRAEDTAVYYCASGGVYGSGSYGDWYIDLWGRGTLVTVSS

SEQ ID NO: 2239 - protein, 18 aa, Artificial Sequence
  Synthetic
ASGGVYGSGSYGDWYIDL

SEQ ID NO: 2240 - protein, 109 aa, Artificial Sequence
  Synthetic
QSVLTQPRSVSGSPGQSVTISCTGTSSDVGGYNYVSWYQQHPGKVPKLMIYDVSKRPSGVPDRFSGSKSGNTASLTISGLQAEDEADYYCCSYAGSYWVFGGGTKLTVL

SEQ ID NO: 2241 - protein, 9 aa, Artificial Sequence
  Synthetic
CSYAGSYWV

SEQ ID NO: 2242 - protein, 127 aa, Artificial Sequence
  Synthetic
QVQLVQSGAEVKKPGSSVKVSCKASGGTFSSYAFIWVRQAPGQGLEWMGGIIPMFGRANYAQKFQGRVTITADESTSTAYMELSSLRSEDTAVYYCARDHYYYTSGGGRPPGGMDVWGQGTTVTVSS

SEQ ID NO: 2243 - protein, 20 aa, Artificial Sequence
  Synthetic
ARDHYYYTSGGGRPPGGMDV

SEQ ID NO: 2244 - protein, 110 aa, Artificial Sequence
  Synthetic
QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLRAWVFGGGTKLTVL

SEQ ID NO: 2245 - protein, 10 aa, Artificial Sequence
  Synthetic
GTWDSSRAWV

SEQ ID NO: 2246 - protein, 128 aa, Artificial Sequence
  Synthetic
EVQLLESGGGLVQPGGSLRLSCAASGFTFRSNAMSWVRQAPGKGLEWVSAISGSGGSTYYADSVKGRFTISRDNSKNTLYVQMNSLRAEDTAVYYCAKYGGYTGYDYPHAYYYGMDVWGQGTTVTVSS

SEQ ID NO: 2247 - protein, 21 aa, Artificial Sequence
  Synthetic
AKYGGYTGYDYPHAYYYGMDV

SEQ ID NO: 2248 - protein, 110 aa, Artificial Sequence
  Synthetic
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTKLTVL

SEQ ID NO: 2249 - protein, 11 aa, Artificial Sequence
  Synthetic
AAWDDSLSGWV

SEQ ID NO: 2250 - protein, 125 aa, Artificial Sequence
  Synthetic
QVQLVQSGSELKKPGASVKVSCKAFGYTFTSYTMHWVRQAPGQGLEWMGWINTYTGDPTYAQDFTGRFVFSLDTSVSTAYLQINTLKAEDTAVYYCARDGELATFGDLWGGMDVWGQGTTVTVSS

SEQ ID NO: 2251 - protein, 18 aa, Artificial Sequence
  Synthetic
ARDGELATFGDLWGGMDV

SEQ ID NO: 2252 - protein, 110 aa, Artificial Sequence
  Synthetic
QSVLTQEPSLTVSPGGTVTLTCGSSTGAVTNGHHPYWFQQKPGQAPRTLIYDTTDKHSWTPARFSGSLLGGKAALTLSGAQPEDEADYYCLLSYSGARRVFGGGTKLTVL

SEQ ID NO: 2253 - protein, 10 aa, Artificial Sequence
  Synthetic
LLSYSGARRV

SEQ ID NO: 2254 - protein, 123 aa, Artificial Sequence
  Synthetic
QVQLQESGPGLVKPSETLSLTCTVSGDSINNYYWSWIRQPPGKGLEWIGYIYNSGSTNYNPSLKSRVTMEVDTSKNQFSLKLSSVTAADTAVYFCARGDSVVSHPALYFFDYWGQGTLVTVSS

SEQ ID NO: 2255 - protein, 17 aa, Artificial Sequence
  Synthetic
ARGDSVVSHPALYFFDY

SEQ ID NO: 2256 - protein, 110 aa, Artificial Sequence
  Synthetic
SYVLTQPPSVSVAPGKTARMTCGENNIGSKSVHWYQQKPGQAPVLVVYDDSDRPSGIPERFSGSNSGNTATLTISRVEAGDEADYYCQVWDSSSGHFHVVFGGGTKLTVL

SEQ ID NO: 2257 - protein, 13 aa, Artificial Sequence
  Synthetic
QVWDSSSGHFHVV

SEQ ID NO: 2258 - protein, 120 aa, Artificial Sequence
  Synthetic
QVQLVQSGAEVKKPGASVKLSCKASGYTFTSYNMNWVRQAPGQGLEWMGIINPSGGTTYAQKFQGRVTMTRDTSTSTVYMELSSLRSEDTAVYYCTREQYRPPQGYFDLWGRGTLVTVSS

SEQ ID NO: 2259 - protein, 14 aa, Artificial Sequence
  Synthetic
TREQYRPPQGYFDL

SEQ ID NO: 2260 - protein, 109 aa, Artificial Sequence
  Synthetic
SYVLTQPPSVSVAPGKTARITCGGNNIGSKNVHWYQQKPGQAPVLVVYDDSDRPSGIPERFSGSNSANTATLTISRVEAGDEADYYCQVWDSSSGLFYVFGTGTKVTVL

SEQ ID NO: 2261 - protein, 12 aa, Artificial Sequence
  Synthetic
QVWDSSSGLFYV

SEQ ID NO: 2262 - protein, 121 aa, Artificial Sequence
  Synthetic
QVQLVESGGGVVQPGRSLRLSCAASGFTFNDFAIHWVRQAPGKGLECVAVISYDGMRKFYADSVKGRFTISRDNSKNTVYLQMNSLRVEDTAVYYCARDGEGIIVAAMDYWGQGTLVTVSS

SEQ ID NO: 2263 - protein, 14 aa, Artificial Sequence
  Synthetic
ARDGEGIIVAAMDY

SEQ ID NO: 2264 - protein, 110 aa, Artificial Sequence
  Synthetic
QSVLTQPPSASGSPGQSVTISCTGTSSDVGGHTFVSWYQQHPGKAPKLMIYEVTKRPSGVPDRFSGSKSGNTASLTVSGLQAEDEAHYYCSSYAGSNNYVFGTGTKVTVL

SEQ ID NO: 2265 - protein, 10 aa, Artificial Sequence
  Synthetic
SSYAGSNNYV

SEQ ID NO: 2266 - protein, 128 aa, Artificial Sequence
  Synthetic
QVQLQQWGAGLLKPSETLSLTCAVFGGSFSGYYWSWIRQPPGKGLEWIGEINHSGSTNYNPSLKSRVTISVDTSKNQFSLKLSSVTAADTAVYYCASQGGYCSGGSCYEASTDIFDYWGQGTLVTVSS

SEQ ID NO: 2267 - protein, 22 aa, Artificial Sequence
  Synthetic
ASQGGYCSGGSCYEASTDIFDY

SEQ ID NO: 2268 - protein, 110 aa, Artificial Sequence
  Synthetic
QSVLTQPPSVSGAPGQRVTISCTGSSSNIGAGYDVHWYQQLPGTAPKLLIYANINRPSGVPDRFSGSKSGTSASLAITGLQAEDEADYYCQSYDSSLSYVFGTGTKVTVL

SEQ ID NO: 2269 - protein, 10 aa, Artificial Sequence
  Synthetic
QSYDSSLSYV

SEQ ID NO: 2270 - protein, 123 aa, Artificial Sequence
  Synthetic
EVQLVQSGAEMKKPGESLKISCKGSGYYFISNWIGWVRQMPGKGLEWMGIIYPGDSDTRYSPSFEGQVTISADKSINTAYLQWSSLKASDTAMYYCARHLGACSGGSCSPDYWGQGTLVTVSS

SEQ ID NO: 2271 - protein, 16 aa, Artificial Sequence
  Synthetic
ARHLGACSGGSCSPDY

SEQ ID NO: 2272 - protein, 110 aa, Artificial Sequence
  Synthetic
QSVLTQPPSASGTPGQRVTISCSGSSSNIGSNTVNWYQQLPGTAPKLFIYNNNQRPSGVPDRFSGSKSGTSASLAISGLQSEDEADYYCAAWDDSLNGGVFGGGTKLTVL

SEQ ID NO: 2273 - protein, 11 aa, Artificial Sequence
  Synthetic
AAWDDSLNGGV

SEQ ID NO: 2274 - protein, 120 aa, Artificial Sequence
  Synthetic
QLQLQESGPGLVKPSETLSLTCTVSGGSISSSSYYWGWIRQPPGKGLQWIGNFYYTGTTYYNPSLKSRVTISVDTSKNQFSLKLSSVTAADTAVYYCATQEWLRDAFHIWGQGTMVTVSS

SEQ ID NO: 2275 - protein, 12 aa, Artificial Sequence
  Synthetic
ATQEWLRDAFHI

SEQ ID NO: 2276 - protein, 111 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDISNHVVFGGGTKLTVL

SEQ ID NO: 2277 - protein, 10 aa, Artificial Sequence
  Synthetic
QSYDISNHVV

SEQ ID NO: 2278 - protein, 125 aa, Artificial Sequence
  Synthetic
EVQLVESGGGLVQPGGSLKLSCAASGFTFSGSAMHWVRQASGKGLEWVGRIRSRPNNYATIYAASVKGRFTISRDDSKNTAYLQMNSLKTEDTAVYYCTRGIAAVGPSENWFHPWGQGTLVTVSS

SEQ ID NO: 2279 - protein, 16 aa, Artificial Sequence
  Synthetic
TRGIAAVGPSENWFHP

SEQ ID NO: 2280 - protein, 108 aa, Artificial Sequence
  Synthetic
SYVLTQPPSVSVAPGKTARITCGGNNIGSKSVHWYQQKPGQAPVVVVYDDSDRPSGIPERFSGSNSGNTATLTISRVEAGDEADYYCQVWDSSTDHVVFGGGTKLTVL

SEQ ID NO: 2281 - protein, 11 aa, Artificial Sequence
  Synthetic
QVWDSSTDHVV

SEQ ID NO: 2282 - protein, 123 aa, Artificial Sequence
  Synthetic
QVQLVESGGGVVQPGRSLRLSCAASGFTFSSYAMHWVRQAPGKGLEWVAIISYDTNSKDYADSVKGRFTISRDNSKNTLFVQMNSLRAEDTAVYYCARGRKAWSGELSSPDYWGQGTLVTVSS

SEQ ID NO: 2283 - protein, 16 aa, Artificial Sequence
  Synthetic
ARGRKAWSGELSSPDY

SEQ ID NO: 2284 - protein, 108 aa, Artificial Sequence [sequence omitted]

SEQ ID NO: 2285 - protein, 11 aa, Artificial Sequence
  Synthetic
QVWDSSSDHYV

SEQ ID NO: 2286 - protein, 124 aa, Artificial Sequence
  Synthetic
QVQLVQSGAEVKKPGSSVKVSCKASGGTFSSYSISWVRQAPGQGLEWMGGIIPILGIANYAQKFQGRVTITADKSTSTAYMELSSLRSEDTAVYYCARDRGYSDYGANNVFDIWGQGTMVTVSS

SEQ ID NO: 2287 - protein, 17 aa, Artificial Sequence
  Synthetic
ARDRGYSDYGANNVFDI

SEQ ID NO: 2288 - protein, 111 aa, Artificial Sequence
  Synthetic
QSVLTQPPSVSGAPGQRVTISCTGSNSNIGAGYDVHWYLQLPGTAPKLLIYANTNRPSGVPDRFSGSKSGTSASLAITGLQAEDEADYYCQSYDSSLSNSIFGGGTKLTVL

SEQ ID NO: 2289 - protein, 11 aa, Artificial Sequence
  Synthetic
QSYDSSLSNSI

SEQ ID NO: 2290 - protein, 122 aa, Artificial Sequence
  Synthetic
QLQLQESGPGLVKPSETLSLTCTVSGGSISSSSYYWGWIRQPPGKGLEWIGSIYYSGSTYYNPSLKSRVTISVDTPKNQFSLKLSSVTAADTAVYYCARFLRYSGNYYFDYWGQGTLVTVSS

SEQ ID NO: 2291 - protein, 14 aa, Artificial Sequence
  Synthetic
ARFLRYSGNYYFDY

SEQ ID NO: 2292 - protein, 108 aa, Artificial Sequence
  Synthetic
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSTVFGTGTKVTVL

SEQ ID NO: 2293 - protein, 8 aa, Artificial Sequence
  Synthetic
SSYAGSTV

SEQ ID NO: 2294 - protein, 122 aa, Artificial Sequence
  Synthetic
QLQLQESGPGLVKPSETLSFTCAVSGGSISSSSYYWGWIRQPPGKGLEWIGSVYYSGITYYNPSLKSRVTISVDTSKNHFSLKLSSVTAADTAVYYCARLFRSGYGGALDPWGQGTLVTVSS

SEQ ID NO: 2295 - protein, 14 aa, Artificial Sequence
  Synthetic
ARLFRSGYGGALDP

SEQ ID NO: 2296 - protein, 110 aa, Artificial Sequence
  Synthetic
QSALTQPASVSGSPGQSITISCTGTSSDVGSYNLVSWYQQHPGKAPKLMISEGSKRPSGVSNRFSGSKSGNTASLTISGLQAEDEADYYCCSYAGSTHVMFGGGTKLTVL

SEQ ID NO: 2297 - protein, 10 aa, Artificial Sequence
  Synthetic
CSYAGSTHVM

SEQ ID NO: 2298 - protein, 124 aa, Artificial Sequence
  Synthetic
QVQLVQSGAEVKKPGSSVKVSCKASGGTFNSYVISWVRQAPGQGLEWMGRIIPIVGIPNYAQKFQGRVTITADKSTSTAYMELSSLRSEDTAVYYCARDVGYSGYGANSYFDYWGQGTLVTVSS

SEQ ID NO: 2299 - protein, 17 aa, Artificial Sequence
  Synthetic
ARDVGYSGYGANSYFDY

SEQ ID NO: 2300 - protein, 111 aa, Artificial Sequence
  Synthetic
QSVLTQPPSVSGAPGQRVTISCTGSSSNIGAGYDVHWYQHLPGTAPKLLIYDNSNRPSGVPDRFSGSKSGTSASLAITGLQPEDEADYYCQSYDSSLSGSVFGGGTKLTVL

SEQ ID NO: 2301 - protein, 11 aa, Artificial Sequence
  Synthetic
QSYDSSLSGSV

SEQ ID NO: 2302 - protein, 118 aa, Artificial Sequence
  Synthetic
QVQLQESGPGLVKPSQTLSLTCTVSGGSISSGSYYWTWIRQPAGKGLEWIGRVYNSGRTNYNPSLKSRVTISLDTSKNQISLKLRSVTAADTAVYYCARVSMTVIDHWGQGTLVTVSS

SEQ ID NO: 2303 - protein, 10 aa, Artificial Sequence
  Synthetic
ARVSMTVIDH

SEQ ID NO: 2304 - protein, 113 aa, Artificial Sequence
  Synthetic
NFMLTQPHSVSESPGKTVTISCTGSSGSIASNYVQWYQQRPGSAPTIVIYEDNQRPSGVPDRFSGSIDSSSNSASLTISGLKTEDEADYYCQSYDFSNHGNWVFGGGTKLTVL

SEQ ID NO: 2305 - protein, 12 aa, Artificial Sequence
  Synthetic
QSYDFSNHGNWV

SEQ ID NO: 2306 - protein, 125 aa, Artificial Sequence
  Synthetic
QVQLQESGPGLVKPSQTLSLTCSVSGGSISSGDYYWSWIRQHPGKGLEWIGYIYYSGNTYYNPSLKSRVTISVDTSKNQFSLKLNSVTAADTAVYYCARFYRYCSSTSCYYFDDWGQGTLVTVSS

SEQ ID NO: 2307 - protein, 17 aa, Artificial Sequence
  Synthetic
ARFYRYCSSTSCYYFDD

SEQ ID NO: 2308 - protein, 109 aa, Artificial Sequence
  Synthetic
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYVGSNVLFGGGTKLTVL

SEQ ID NO: 2309 - protein, 9 aa, Artificial Sequence
  Synthetic
SSYVGSNVL

SEQ ID NO: 2310 - protein, 122 aa, Artificial Sequence
  Synthetic
QLQLQESGPGLVKPSETLSLTCTVSGGSISINTYYWGWIRQPPGKGLEWIGSIYYSGSTYYNPSLKSRVTISVDTSTNQFSLKLTSVTAADTAVYYCARRYSLLSGYTFDYWGQGTLVTVSS

SEQ ID NO: 2311 - protein, 14 aa, Artificial Sequence
  Synthetic
ARRYSLLSGYTFDY

SEQ ID NO: 2312 - protein, 110 aa, Artificial Sequence
  Synthetic
QSVLTQPPSVSEAPRKRVTISCSGSSSNIGNNAVNWYQRLPGKAPKLLIYYDDLLPLGVFDRFSGSKSGTSASLAISGLQSEDEADYYCAAWDDSLNGPVFGGGTKLTVL

SEQ ID NO: 2313 - protein, 11 aa, Artificial Sequence
  Synthetic
AAWDDSLNGPV

SEQ ID NO: 2314 - protein, 119 aa, Artificial Sequence
  Synthetic
QVQLVQSGAEVKKPGASVKVSCKASGYTFTSYFMHWVRQAPGQGLQWMGIINPSGGSTSYAQKFQGRVTMTRDTSTSTVYMELSSLRSEDTAVYYCARWYDSLNYHDYWGQGTLVTVSS

SEQ ID NO: 2315 - protein, 12 aa, Artificial Sequence
  Synthetic
ARWYDSLNYHDY

SEQ ID NO: 2316 - protein, 111 aa, Artificial Sequence
  Synthetic
QSVLTQPASVSGSPGQSITFSCTGTSSDVGGYNYVSWYQQHPGKAPKLMIYDVSNRPSGVSNRFSASKSGNTASLTISGLQAEDEADYYCSSYTSSSTLYVFGTGTKVTVL

SEQ ID NO: 2317 - protein, 11 aa, Artificial Sequence
  Synthetic
SSYTSSSTLYV

SEQ ID NO: 2318 - protein, 122 aa, Artificial Sequence
  Synthetic
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDLRSGWYSMGAFDIWGQGTMVTVSS

SEQ ID NO: 2319 - protein, 16 aa, Artificial Sequence
  Synthetic
ARDLRSGWYSMGAFDI

SEQ ID NO: 2320 - protein, 110 aa, Artificial Sequence
  Synthetic
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 2321 - protein, 10 aa, Artificial Sequence
  Synthetic
SSYAGSNNWV

SEQ ID NO: 2322 - protein, 120 aa, Artificial Sequence
  Synthetic
QVQLVESGGGVVQPGRSLRLSCAASGFTFSTCAMHWVRQAPGKGLEWVAVISYDGRNKYYADSVKGRLTISRDNSKNTLYLQMNSLRPEDTAVYYCARDLSNSFWGAEYWGQGALVTVSS

SEQ ID NO: 2323 - protein, 13 aa, Artificial Sequence
  Synthetic
ARDLSNSFWGAEY

SEQ ID NO: 2324 - protein, 110 aa, Artificial Sequence
  Synthetic
QSVLTQPPSASGSPGQSVTISCTGTSSDVGGYNYVSWYQQHPGKAPKLMIYEVSKRPSGVPDRFSGSKSGNTASLTVSGLQAEDEANYYCSSYGGNNNLVFGGGTKLTVL

SEQ ID NO: 2325 - protein, 10 aa, Artificial Sequence
  Synthetic
SSYGGNNNLV

SEQ ID NO: 2326 - protein, 124 aa, Artificial Sequence
  Synthetic
QVQLVQSGAEVKKPGSSVKVSCKASGATFSSNTISWVRQAPGQGLEWMGRVIPILGIADYAQKFQGRVTITTDKSTSTVFMELSSLRSEDTAVYYCATDPGYSDHGANSYFDYWGQGTLVTVSS

SEQ ID NO: 2327 - protein, 17 aa, Artificial Sequence
  Synthetic
ATDPGYSDHGANSYFDY

SEQ ID NO: 2328 - protein, 111 aa, Artificial Sequence
  Synthetic
QSVLTQPPSVSGAPGQRVTISCTGSNSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 2329 - protein, 11 aa, Artificial Sequence
  Synthetic
QSYDSSLSGSV

SEQ ID NO: 2330 - protein, 127 aa, Artificial Sequence
  Synthetic
EVQLVQSGAEVEKPGESLKISCKGSGYSFTRYWIGWVRQMPGKGLEWMGIIYPGDSDTRYSPSFQGQVTISADKSISTAYLQWSSLKASDTAMYYCARHLHYYDSSGYGSWVHADYWGQGTLVTVSS

SEQ ID NO: 2331 - protein, 20 aa, Artificial Sequence
  Synthetic
ARHLHYYDSSGYGSWVHADY

SEQ ID NO: 2332 - protein, 110 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSEVFGGGTKLTVL

SEQ ID NO: 2333 - protein, 10 aa, Artificial Sequence
  Synthetic
QSYDSSLSEV

SEQ ID NO: 2334 - protein, 125 aa, Artificial Sequence
  Synthetic
EVQLLESGGGLVQPGGSLRLSCAASGFTISNYAMTWVRQAPGKGLEWVSAISGSGSSTYYADSVKGRFTISRDNSKNTLYLQMNSLRAEDTAVYYCASGGAYGSGSYGDWYFDLWGRGTLVTVSS

SEQ ID NO: 2335 - protein, 18 aa, Artificial Sequence
  Synthetic
ASGGAYGSGSYGDWYFDL

SEQ ID NO: 2336 - protein, 109 aa, Artificial Sequence
  Synthetic
QSVLTQPRSVSGSPGQSVTISCTGTSSDIGGYNFVSWYQQHPGKAPKFMIYDVSKRPSGVPDRFSGSKSGNTASLTISGLQAEDEADYYCCSYVGSYWVFGGGTKLTVL

SEQ ID NO: 2337 - protein, 9 aa, Artificial Sequence
  Synthetic
CSYVGSYWV

SEQ ID NO: 2338 - protein, 125 aa, Artificial Sequence
  Synthetic
EVQLLESGGGLVQPGGSLRLSCTASGFTFSSYAMYWVRQAPGKGLEWVSTISGSGGSTYFADSVKGRFTISRDNSKNTVYLQMNSLRAEDTAVYYCASGGAYGSGSYGDWYFDLWGRGTLVTVSS

SEQ ID NO: 2339 - protein, 18 aa, Artificial Sequence
  Synthetic
ASGGAYGSGSYGDWYFDL

SEQ ID NO: 2340 - protein, 109 aa, Artificial Sequence
  Synthetic
QSVLTQPRSVSGSPGQSVTISCTGTSSDVGGYNYVSWYQQHPGKVPKFMIYDVSKRPSGVPDRFSGSKSGNTASLTISGLQGEDEADYYCCSYAGSYWVFGGGTKLTVL

SEQ ID NO: 2341 - protein, 9 aa, Artificial Sequence
  Synthetic
CSYAGSYWV

SEQ ID NO: 2342 - protein, 120 aa, Artificial Sequence
  Synthetic
EVQLVESGGGLVQPGGSLRLSCAASGFTFSSYWMYWVRQAPGKGLVWVSRVNSDGSSTNYADSVKGRFTISRDNAKNTLFLLMNSLRAEDTAVYYCVRKIQLWGSYFDYWGQGTLVTVSS

SEQ ID NO: 2343 - protein, 13 aa, Artificial Sequence
  Synthetic
VRKIQLWGSYFDY

SEQ ID NO: 2344 - protein, 110 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDTDHEVFGGGTKLTVL

SEQ ID NO: 2345 - protein, 9 aa, Artificial Sequence
  Synthetic
QSYDTDHEV

SEQ ID NO: 2346 - protein, 124 aa, Artificial Sequence
  Synthetic
QLQLQESGPGLVKPSETLSLTCTVSGGSISSSTYYWDWIRQPPGKGLEWIGRIYYSGSTYYNPSLKSRVTISVDTSKNQFSLKLSSVTAADTAVYYCARALRYYGLGSGAFDIWGQGTMVTVSS

SEQ ID NO: 2347 - protein, 16 aa, Artificial Sequence
  Synthetic
ARALRYYGLGSGAFDI

SEQ ID NO: 2348 - protein, 110 aa, Artificial Sequence
  Synthetic
QSVLTQPPSASGSPGQSVTISCTGTSSDVGTYNYVSWYQQHPGKAPKLMIYEVSQRPSGVPDRFSGSKSGNTASLTVSGLQAEDEADYYCSSYAGSNNVIFGGGTKLTVL

SEQ ID NO: 2349 - protein, 10 aa, Artificial Sequence
  Synthetic
SSYAGSNNVI

SEQ ID NO: 2350 - protein, 122 aa, Artificial Sequence
  Synthetic
QVQLVQSGAEVKKPGASVKVSCKASGYTFTGYYMHWVRQAPGQGLEWMGRINPNNGDTNYAQKFQGRVTMTRDTSISTAYMELSRLRSDDTVVYYCARGPYGWELGAYFDYWGQGTLVTVSS

SEQ ID NO: 2351 - protein, 15 aa, Artificial Sequence
  Synthetic
ARGPYGWELGAYFDY

SEQ ID NO: 2352 - protein, 110 aa, Artificial Sequence
  Synthetic
QSVLTQPPSASGTPGQRVTISCSGSSSNIGSNYVNWYQQLPGTAPKLLIYSNNQRPSGVPDRFSGSKSGTSASLAISGLQSEDEADYYCASWDDSLDAVVFGGGTKLTVL

SEQ ID NO: 2353 - protein, 11 aa, Artificial Sequence
  Synthetic
ASWDDSLDAVV

SEQ ID NO: 2354 - protein, 121 aa, Artificial Sequence
  Synthetic
EVQLVQSGAEVKKPGESLKISCKGSGYSFISYWIGWMHQMPGKGLEWMGIIYPGDSDTRYSPSFQGQVTISADRSISTAYLQWSSLKASDTAMYYCARGLTYGDSYAFDIWGQGTMVTVSS

SEQ ID NO: 2355 - protein, 14 aa, Artificial Sequence
  Synthetic
ARGLTYGDSYAFDI

SEQ ID NO: 2356 - protein, 112 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSGVFGTGTKVTVL

SEQ ID NO: 2357 - protein, 12 aa, Artificial Sequence
  Synthetic
QSYDSSLSGSGV

SEQ ID NO: 2358 - protein, 124 aa, Artificial Sequence
  Synthetic
QVQLVQSGAAVKMPGSSVKVSCKASGGTFNSYPISWVRQAPGQGLEWMGRIIPILSIPNYAQNFQGRVTITADKTTTTAYMELSSLRSEDTAVYYCARDPGYSGYGANSYFDYWGQGTLVTVSS

SEQ ID NO: 2359 - protein, 17 aa, Artificial Sequence
  Synthetic
ARDPGYSGYGANSYFDY

SEQ ID NO: 2360 - protein, 111 aa, Artificial Sequence
  Synthetic
QSVLTQPPSVSGAPGQRVTISCTGSSSNIGAGYDVHWYQQLPGTAPKLLIYANTNRPSGVPDRFSGSKSDTSASLAITGLQAEDEADYYCQSYDSSQSDSVFGGGTKLTVL

SEQ ID NO: 2361 - protein, 11 aa, Artificial Sequence
  Synthetic
QSYDSSQSDSV

SEQ ID NO: 2362 - protein, 126 aa, Artificial Sequence
  Synthetic
QVQLVQSGAEVKKPGSSVKVSCKASGGTFSTSAISWVRQAPGQRLEWMGGIIPIFGAANYAPRFQGRVTIIADESTSTAYMELSSLISEDTAVYYCARAPGYCTGGSCYKSGLGYWGQGTLVTVSS

SEQ ID NO: 2363 - protein, 19 aa, Artificial Sequence
  Synthetic
ARAPGYCTGGSCYKSGLGY

SEQ ID NO: 2364 - protein, 105 aa, Artificial Sequence
  Synthetic
SYVLTQPPSVSVAPGKTARITCGGNNIGSKSVHWYQQKPGQAPVLVVYDDSDRPSGIPERFSGSNSGNTATLTISRVEAGDEAGYYCQVWDSRVLFGGGTTLTVL

SEQ ID NO: 2365 - protein, 8 aa, Artificial Sequence
  Synthetic
QVWDSRVL

SEQ ID NO: 2366 - protein, 120 aa, Artificial Sequence
  Synthetic
QLQLQESGPGLVKPSETLSLTCTVSGGSISSSSYFWGWIRQPPGKGLEWIGSITYSGSTYYNPSLKSRVTFSVDTSKNQFSLKVSSVTAADTAVYYCARRGWLRDRVDYWGQGTLVTVSS

SEQ ID NO: 2367 - protein, 12 aa, Artificial Sequence
  Synthetic
ARRGWLRDRVDY

SEQ ID NO: 2368 - protein, 111 aa, Artificial Sequence
  Synthetic
NFMLTQPHSVSESPGKTVTISCTGSSGYIASNYVHWYQQRPGSAPTTVIYEDNQRPSGVPDRFSGSIDSSSNSASLTISGLQTEDEADYYCQSYDSSIHVVFGGGTKLTVL

SEQ ID NO: 2369 - protein, 10 aa, Artificial Sequence
  Synthetic
QSYDSSIHVV

SEQ ID NO: 2370 - protein, 130 aa, Artificial Sequence
  Synthetic
EVQLVESGGGVVQPGGSLRLSCAASGFTFDDYAMHWVRQAPGKGLEWVSLISGDGAITYYADSVKGRFTISRDNSKNSLSLQMNSLRTEDTALYYCAKDLETMNIAVAGLYYYFYGMDVWGQGTTVTVSS

SEQ ID NO: 2371 - protein, 23 aa, Artificial Sequence
  Synthetic
AKDLETMNIAVAGLYYYFYGMDV

SEQ ID NO: 2372 - protein, 110 aa, Artificial Sequence
  Synthetic
QSVLTQPPSASGTPGQRVTISCSGSSSNIGSNPVNWYQQLPGTAPKLLIYGNNQRPSGVPDRFSGSKSGTSASLAISGLQSEDEADYYCATWDDSLNGWVFGGGTKLTVL

SEQ ID NO: 2373 - protein, 11 aa, Artificial Sequence
  Synthetic
ATWDDSLNGWV

SEQ ID NO: 2374 - protein, 123 aa, Artificial Sequence
  Synthetic
EVQLVESGGRLVKPGGSLRLSCAASRFTFSTYTMNWVRQAPGKGLEWVSSISSSSYIYYADSVKGRFTISRDNAKNSLYLQMNSLRAEDTAVYYCAREASKWELLRWYYFDYWGQGTLVTVSS

SEQ ID NO: 2375 - protein, 17 aa, Artificial Sequence
  Synthetic
AREASKWELLRWYYFDY

SEQ ID NO: 2376 - protein, 110 aa, Artificial Sequence
  Synthetic
QSVLTQPRSVSGSPGQSVTISCTGTSSDVGGYNYVSWYQQHPGKAPKLMIYDVTKRPSGVPDRFSGSKSGNTASLTISGLQAEDEADYYCCSYAGNNSLVFGGGTKLTVL

SEQ ID NO: 2377 - protein, 10 aa, Artificial Sequence
  Synthetic
CSYAGNNSLV

SEQ ID NO: 2378 - protein, 122 aa, Artificial Sequence
  Synthetic
QVQLVESGGGVVQPGRSLRLSCAASGFTFSSYAIHWVRQAPGKGLEWVAVISNDGSNKYYVDSVKGRFTISRDNSKNTLYLQMKSLRPEDTAVYYCTREPTAQGPTDYFDYWGQGTLVTVSS

SEQ ID NO: 2379 - protein, 15 aa, Artificial Sequence
  Synthetic
TREPTAQGPTDYFDY

SEQ ID NO: 2380 - protein, 109 aa, Artificial Sequence
  Synthetic
SYVLTQPPSVSVAPGKTASITCGGNNIGSKNVHWYQQKPGQAPVLVVYDDSDRPSGIPERFSGSNSGNTATLTISRVEAGDEADYYCQVWDSSSDHHVVFGGGTKLTVL

SEQ ID NO: 2381 - protein, 12 aa, Artificial Sequence
  Synthetic
QVWDSSSDHHVV

SEQ ID NO: 2382 - protein, 118 aa, Artificial Sequence
  Synthetic
EVQLVQSGAEVKKPGESLKISCKGSGYSFISYWIGWVRQKPGKGLEWMGVIYPGDSDTIYSPSFQGQVTISADRSITTAYLQWSSLKASDTAMYYCARRDGTPTVDYWGQGTLVTVSS

SEQ ID NO: 2383 - protein, 11 aa, Artificial Sequence
  Synthetic
ARRDGTPTVDY

SEQ ID NO: 2384 - protein, 110 aa, Artificial Sequence
  Synthetic
QSVLTQPPSASGTPGQRVTISCSGGSSNIGSNAVNWHQQLPGTAPKLLIYTNNQRPSGVPDRFSGSKSGTSASLAISGLQSEDEADYYCAAWDDSLNDYVFGTGTKVTVL

SEQ ID NO: 2385 - protein, 11 aa, Artificial Sequence
  Synthetic
AAWDDSLNDYV

SEQ ID NO: 2386 - protein, 128 aa, Artificial Sequence
  Synthetic
QVQLVQSGAEVKKPGASVEVSCKASGYTFTSYYIHWVRQAPGQGLEWMGIINPSGGSTSYAQRFQGRVTVTRDTSTSTVYMELSSLRSEDTAVYYCAREVLMGGDYEPRYYYYGMDVWGQGTTVTVSS

SEQ ID NO: 2387 - protein, 21 aa, Artificial Sequence
  Synthetic
AREVLMGGDYEPRYYYYGMDV

SEQ ID NO: 2388 - protein, 108 aa, Artificial Sequence
  Synthetic
SYVLTQPPSVSVSPGQTARIPCSADGLPKQYAYWYQQKPGQAPVLVIYKDSERPSGIPERFSGSSSGTTVTLTISGVQAEDEADYYCQSADSRGTYVVFGGGTKLTVL

SEQ ID NO: 2389 - protein, 11 aa, Artificial Sequence
  Synthetic
QSADSRGTYVV

SEQ ID NO: 2390 - protein, 119 aa, Artificial Sequence
  Synthetic
EVQLVESGGGLIQPGGSLRLSCAASEIIVSSNYMNWVRQAPGKGLEWVSLIYSGGSAYYADSVKGRFTISRDNSKNTLYLQMNSLRADDTAVYFCARGDLDTPYGLDVWGQGTTVTVSS

SEQ ID NO: 2391 - protein, 13 aa, Artificial Sequence
  Synthetic
ARGDLDTPYGLDV

SEQ ID NO: 2392 - protein, 110 aa, Artificial Sequence
  Synthetic
QSVLTQPPSVSAAPGQKVTISCSGSSSNIGNNYVSWYQHLPGTAPKLLIYDNNKRPSGIPDRFSGSKSGTSATLGITGLRTGDEADYYCGTWDRSLSVGVFGGGTKLTVL

SEQ ID NO: 2393 - protein, 11 aa, Artificial Sequence
  Synthetic
GTWDRSLSVGV

SEQ ID NO: 2394 - protein, 123 aa, Artificial Sequence
  Synthetic
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGVRGVIILYNWFDPWGQGTLVTVSS

SEQ ID NO: 2395 - protein, 15 aa, Artificial Sequence
  Synthetic
AGVRGVIILYNWFDP

SEQ ID NO: 2396 - protein, 110 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNVVFGGGTKLTVL

SEQ ID NO: 2397 - protein, 9 aa, Artificial Sequence
  Synthetic
QSYDSSNVV

SEQ ID NO: 2398 - protein, 116 aa, Artificial Sequence
  Synthetic
QVQLQQWGAGLLKPSETLSLTCAVYGGSFSGYYWIWIRQPPGKGLEWIGEINHSGSTNYNPSLKSRVTISVDTSKNQFSLKLSSVTAADTAVYYCARIDYYDSLDWGQGTLVTVSS

SEQ ID NO: 2399 - protein, 10 aa, Artificial Sequence
  Synthetic
ARIDYYDSLD

SEQ ID NO: 2400 - protein, 109 aa, Artificial Sequence
  Synthetic
QSVLTQEPSLTVSPGGTVTLTCGSSTGAVTSGHYPYWFQQKPGQAPRTLIYDTSNKHSWTPARFSGSLLGGKAALTLSGAQPEDEADYYCFLSHSGARVFGGGTKLTVL

SEQ ID NO: 2401 - protein, 9 aa, Artificial Sequence
  Synthetic
FLSHSGARV

SEQ ID NO: 2402 - protein, 120 aa, Artificial Sequence
  Synthetic
QVQLVESGGGVVQPGRSLRLSCAASGFTFSDYAMHWVRQAPGKGLEWVAIISYDGSIKYYVESVKGRFTISRDNSKNTLYLQMNSLTAEDTAVYYCARTRSGWTDAFDIWGQGTMVTVSS

SEQ ID NO: 2403 - protein, 13 aa, Artificial Sequence
  Synthetic
ARTRSGWTDAFDI

SEQ ID NO: 2404 - protein, 110 aa, Artificial Sequence
  Synthetic
QSVLTQPPSASGTPGQRVTISCSGSSSNIGSNSVNWYQQLPGTAPKLLIYSNNQRPSGVPDRFSGSKSGTSASLAISGLQSEDEADYYCAAWDDSLTGWVFGGGTKLTVL

SEQ ID NO: 2405 - protein, 11 aa, Artificial Sequence
  Synthetic
AAWDDSLTGWV

SEQ ID NO: 2406 - protein, 120 aa, Artificial Sequence
  Synthetic
EVQLVQSGAEVKKPGESLRISCKGSGYSFTNYWITWVRQMPGKGLEWMGRIDPSDSYTNYSPSFQGHVTISADKSISTAYLQWSSLKASDTAMYYCARQLCGGDCYPDYWGQGTLVTVSS

SEQ ID NO: 2407 - protein, 13 aa, Artificial Sequence
  Synthetic
ARQLCGGDCYPDY

SEQ ID NO: 2408 - protein, 110 aa, Artificial Sequence
  Synthetic
QSVLTQPASVSGSPGQSITISCTGTTSDLGGYNYVSWYQQHPGKAPKLMIYDVSYRPSGVSNRFSGSKSANTASLTISGLQAEDEADYYCSSYTSSSTLVFGGGTKLTVL

SEQ ID NO: 2409 - protein, 10 aa, Artificial Sequence
  Synthetic
SSYTSSSTLV

SEQ ID NO: 2410 - protein, 125 aa, Artificial Sequence
  Synthetic
EVQLVESGGGLVQPGGSLRLSCAASGFTFSSYEMNWVRQAPGKGLEWVSYISSSGTTIYYADSVKGRYTISRDNAKNSLYLQMNSLRAEDTAVYYCARELRVWLPREYYYGMDVWGQGTTVTVSS

SEQ ID NO: 2411 - protein, 18 aa, Artificial Sequence
  Synthetic
ARELRVWLPREYYYGMDV

SEQ ID NO: 2412 - protein, 108 aa, Artificial Sequence
  Synthetic
SYVLTQPPSVSLAPGKTARITCGGNNIGSKSVHWYQQKPGQAPVLVIYYDSDRPSGIPERFSGSNSGNTATLTISRVEAGDEADYYCQVWDSSSDHWVFGGGTKLTVL

SEQ ID NO: 2413 - protein, 11 aa, Artificial Sequence
  Synthetic
QVWDSSSDHWV

SEQ ID NO: 2414 - protein, 126 aa, Artificial Sequence
  Synthetic
QVQLQESGPGLVKPSQTLSLTCTVSGGSISSGGYYWSWIRQHPGKGLECIGYIYYSGSTYYNPSLKSRVTISVDTKNQFSLNLSSVTAADTAVYYCARVLYCSGDSCSTHNRFDPWGQGTPVTVSS

SEQ ID NO: 2415 - protein, 19 aa, Artificial Sequence
  Synthetic
ARVLYCSGDSCSTHNRFDP

SEQ ID NO: 2416 - protein, 111 aa, Artificial Sequence
  Synthetic
QSVLTQPPSVSGAPGQRVTISCTGSSSNIGAGYAVHWYQQLPGTAPKLLIYGNNNRPSGVPDRFSGSKSGTSASLAISGLQAEDEADYYCQSYDRSLSDSVFGGGTKLTVL

SEQ ID NO: 2417 - protein, 11 aa, Artificial Sequence
  Synthetic
QSYDRSLSDSV

SEQ ID NO: 2418 - protein, 118 aa, Artificial Sequence
  Synthetic
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLMERGGLDYWGQGTLVTVSS

SEQ ID NO: 2419 - protein, 12 aa, Artificial Sequence
  Synthetic
ARDLMERGGLDY

SEQ ID NO: 2420 - protein, 110 aa, Artificial Sequence
  Synthetic
EIVLTQSPGTLSLSPGERATLSCRASQSISSSYLAWYQQKPGQAPRLLIYGASSRATGIPDRFSGSGSGTDFTLTISRLEPEDFAVYYCQQYGSSPPLITFGQGTKLEIK

SEQ ID NO: 2421 - protein, 11 aa, Artificial Sequence
  Synthetic
QQYGSSPPLIT

SEQ ID NO: 2422 - protein, 127 aa, Artificial Sequence
  Synthetic
QVQLVQSGAEVKKPGASVKVSCKASGYTLVNYGISWVRQAPGQGLEWMGWINSYNGNIKYAQKLQGRVIMTTDPSTSTAYMELRSLKSDDTAVYYCARRARIAVAGTPAYYYGMDVWGQGTTVTVSS

SEQ ID NO: 2423 - protein, 20 aa, Artificial Sequence
  Synthetic
ARRARIAVAGTPAYYYGMDV

SEQ ID NO: 2424 - protein, 112 aa, Artificial Sequence
  Synthetic
DIVMTQSPLSLPVTPGEPASISCRSSQSLLHTNGYNYLDWYLQKPGQSPQLLIYLGSNRASGVPDRFSGSGSGTDFTLKISRVEAEDVGVYYCMQALQTPYTFGQGTKLEIK

SEQ ID NO: 2425 - protein, 9 aa, Artificial Sequence
  Synthetic
MQALQTPYT

SEQ ID NO: 2426 - protein, 118 aa, Artificial Sequence
  Synthetic
EVQLVESGGGLVQPGGSLRLSCAASGLTVSRNYMNWVRQAPGKGLEWVSVIYSGGTTYYADSVKGRFTISRDNSKNTLYLQMNSLRAEDSAVYYCARDLGISGAFDIWGQGTMVTVSS

SEQ ID NO: 2427 - protein, 12 aa, Artificial Sequence
  Synthetic
ARDLGISGAFDI

SEQ ID NO: 2428 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLDSYPALTFGGGTKVEIK

SEQ ID NO: 2429 - protein, 10 aa, Artificial Sequence
  Synthetic
QQLDSYPALT

SEQ ID NO: 2430 - protein, 118 aa, Artificial Sequence
  Synthetic
EVQLVESGGGLIQPGGSLRLSCAASGVTVSSNYMSWVRQAPGKGLEWVSLIYSGGSTYYADSVKGRFTISRDNSKNTLYLQMSSLRAEDTAVYYCARDLEEAGAYDIWGQGTMVTVSS

SEQ ID NO: 2431 - protein, 12 aa, Artificial Sequence
  Synthetic
ARDLEEAGAYDI

SEQ ID NO: 2432 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLQTFGQGTKVEIK

SEQ ID NO: 2433 - protein, 9 aa, Artificial Sequence
  Synthetic
QQYGSSLQT

SEQ ID NO: 2434 - protein, 122 aa, Artificial Sequence
  Synthetic
EVQLVESGGGLVKPGGSLRLSCAASGFPFITYTMNWVRQAPGKGLEWVSSISSRSGYINYADSVKGRFTISRDNAKNSLYLQMNSLRAEDTAVYYCARERNRGLRQDAFDIWGQGTVVTVSS

SEQ ID NO: 2435 - protein, 15 aa, Artificial Sequence
  Synthetic
ARERNRGLRQDAFDI

SEQ ID NO: 2436 - protein, 112 aa, Artificial Sequence
  Synthetic
DIVMTQSPLSLPVTPGEPASISCRSSQSLLYSNGYNYLDWYLQKPGQSPQLLIYLGSNRASGVPDRFSGSGSGTDFTLKIRRVEADDVGVYYCMQALQTPYTFGQGTKLEIK

SEQ ID NO: 2437 - protein, 9 aa, Artificial Sequence
  Synthetic
MQALQTPYT

SEQ ID NO: 2438 - protein, 125 aa, Artificial Sequence
  Synthetic
QVQLVQSGAEVKKPGSSVKVSCKASGGTFSSYAISWVRQAPGQGLEWLGRIIPILNIANYAQKFQGRVTITADKSTSTAYMELSSLGSQDTAVYYCASTIAVAGIRTLGFYFDNWGQGTLVTVSS

SEQ ID NO: 2439 - protein, 18 aa, Artificial Sequence
  Synthetic
ASTIAVAGIRTLGFYFDN

SEQ ID NO: 2440 - protein, 106 aa, Artificial Sequence
  Synthetic
EIVMTQSPATLSVFPGERATLSCRASQSVSSNLAWYQQKPGQAPRLLIYGASTRATGIPARFSGSGSGTEFTLTISSLQSEDFAVYYCQQYNNWLTFGGGTKVEIK

SEQ ID NO: 2441 - protein, 8 aa, Artificial Sequence
  Synthetic
QQYNNWLT

SEQ ID NO: 2442 - protein, 122 aa, Artificial Sequence
  Synthetic
EVQLLESGGGLVQPGGSLRLSCAASGFTFSSYAMSWVRQAPGKGLEWVSGISGSGDITYYADSVKGRFTISRDNSKNTLHLQMNSLKAEDTAVYYCAKDAGVITMIVVDTYWGQGTLVTVSS

SEQ ID NO: 2443 - protein, 15 aa, Artificial Sequence
  Synthetic
AKDAGVITMIVVDTY

SEQ ID NO: 2444 - protein, 107 aa, Artificial Sequence
  Synthetic
DIQMTQSPSSLSASVGDRVTITCRASQSINNYLNWYQQKPGKAPKLLIYAASSLQSGVPSRFSGSGSATDFTLTISSLQPKDFATYYCQQSYTTPPTFGQGTQLEIK

SEQ ID NO: 2445 - protein, 9 aa, Artificial Sequence
  Synthetic
QQSYTTPPT

SEQ ID NO: 2446 - protein, 120 aa, Artificial Sequence
  Synthetic
EVQLVESGGGLVQPGGSLRLSCAASGFTFSNYDMHWVRQAAGKGLEWVSTIGTAGDTYYPDSVKGRFTISRENARKSLYLQMNSLRAGDTAVYYCARGGRLTNVVEFDYWGQGTLVTVSS

SEQ ID NO: 2447 - protein, 14 aa, Artificial Sequence
  Synthetic
ARGGRLTNVVEFDY

SEQ ID NO: 2448 - protein, 108 aa, Artificial Sequence
  Synthetic
DIQMTQSPSSLSASVGDRVTITCRASQSISTYLNWYQQKPGKAPKLLIYSASSLQSGVPSRFSGSGSGTDFTLTISSLQPEDFATYFCQQSYSMPPITFGQGTRLEIK

SEQ ID NO: 2449 - protein, 10 aa, Artificial Sequence
  Synthetic
QQSYSMPPIT

SEQ ID NO: 2450 - protein, 117 aa, Artificial Sequence
  Synthetic
QVQLVESGGGVVQPGRSLRLSCAASGFTFSSYAMHWVRQAPGKGLEWVAVISHDGSNEFYVDSVKGRFTISRDNSKNTVYLQMNSLRAEDTAVYNCARESFRAAVAWGQGTMVTVSS

SEQ ID NO: 2451 - protein, 10 aa, Artificial Sequence
  Synthetic
ARESFRAAVA

SEQ ID NO: 2452 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDSATYYCQQSYSPLWTFGQGTKVEIK

SEQ ID NO: 2453 - protein, 9 aa, Artificial Sequence
  Synthetic
QQSYSPLWT

SEQ ID NO: 2454 - protein, 118 aa, Artificial Sequence
  Synthetic
EVQLVESGGGLVQSGGSLRLSCAASGLIVSSNYMSWVRQAPGKGLEGVSVIYSGGSTYYADSVKGRFTISRDNSKNTLYLQMNSLRAEDTAVYYCARGSGDYYGMDVWGQGTTVTVSS

SEQ ID NO: 2455 - protein, 12 aa, Artificial Sequence
  Synthetic
ARGSGDYYGMDV

SEQ ID NO: 2456 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDLATYYCQRLNSYPPYTFGQGTKLEIK

SEQ ID NO: 2457 - protein, 10 aa, Artificial Sequence
  Synthetic
QRLNSYPPYT

SEQ ID NO: 2458 - protein, 124 aa, Artificial Sequence
  Synthetic
EVQLVQSGAEVKKPGESLKISCKGSGYSFITYWIGWVRQMPGKGLEWMGIIYPGDSDTRYSPSFQGQVTISADKSISTAYLQWSSLKASDTAMYYCARLEAAAGRTPWASFDYWGQGTLVTVSS

SEQ ID NO: 2459 - protein, 17 aa, Artificial Sequence
  Synthetic
ARLEAAAGRTPWASFDY

SEQ ID NO: 2460 - protein, 110 aa, Artificial Sequence
  Synthetic
DIVMTQSPLSLPVTPGEPASISCRSSQSLLHSNGYNYLDWYLQKPGQSPQLLIYLSSNRASGVPDRFSGSGSGTDFTLKISRVEAEDVGVYYCMQSLQGTFGGGTKVEIK

SEQ ID NO: 2461 - protein, 7 aa, Artificial Sequence
  Synthetic
MQSLQGT

SEQ ID NO: 2462 - protein, 119 aa, Artificial Sequence
  Synthetic
EVQLVESGGGLVQPGGSLRLSCAASGFIFSSYEMNWVRQAPGKGLEWVSDINSSGNAIYYADSVKGRFTISRDNAKNSLYLQINSLRAEDTAVYYCARGNWPNFGMDVWGQGTTVTVSS

SEQ ID NO: 2463 - protein, 12 aa, Artificial Sequence
  Synthetic
ARGNWPNFGMDV

SEQ ID NO: 2464 - protein, 109 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPWTFGQGTKVEIK

SEQ ID NO: 2465 - protein, 10 aa, Artificial Sequence
  Synthetic
QQYGSSPPWT

SEQ ID NO: 2466 - protein, 117 aa, Artificial Sequence
  Synthetic
EVQLVESGGGLVQPGGSLRLSCAASGLTVSSNYMNWVRQAPGKGLEWVSILYSGGSTYYADSVKGRFTISRDNSKNTLSLQMNNLRAEDTAVYYCARDLNYYGMDVWGQGTTVTVSS

SEQ ID NO: 2467 - protein, 11 aa, Artificial Sequence
  Synthetic
ARDLNYYGMDV

SEQ ID NO: 2468 - protein, 106 aa, Artificial Sequence
  Synthetic
DIQLTQSPSFLSASVGDRVTITCRASQGISNHLAWYQQKPGKAPKLLIYAASTLQSGVPSRFSGSGSGTDFTLTISSLQPEDFATYYCQQVNSYPLFGGGTKVEIK

SEQ ID NO: 2469 - protein, 8 aa, Artificial Sequence
  Synthetic
QQVNSYPL

SEQ ID NO: 2470 - protein, 118 aa, Artificial Sequence
  Synthetic
EVQLVESGGGLVQPGGSLRLSCAASGITVRSNYMTWVRQAPGKGLEWVSVLYSGGSTFYADSVKGRFTISRDNSKNTLYLQMNRLRAEDTAVYYCARDLAERGGMDVWGQGTTVTVSS

SEQ ID NO: 2471 - protein, 12 aa, Artificial Sequence
  Synthetic
ARDLAERGGMDV

SEQ ID NO: 2472 - protein, 105 aa, Artificial Sequence
  Synthetic
EIVLTQSPLSLSPGERATLSCRASQSVSSSYLAWYQQKPGQAPRLLIYGASSRATGIPDRFSGSGSGTDFTLTISRLEPEDFAVYYCQQYGSLYTFGQGTKLEIK

SEQ ID NO: 2473 - protein, 8 aa, Artificial Sequence
  Synthetic
QQYGSLYT

SEQ ID NO: 2474 - protein, 117 aa, Artificial Sequence
  Synthetic
EVQLVESGGGLVQPGGSLRLSCAVSGFTVSSNYMTWVRQAPGKGLEWVSVIYSGGSTFYADSVKGRFTISRDNSKNTLFLQMNSLRAEDTAVYYCARDSAPRIPAIWGQGTMVTVSS

SEQ ID NO: 2475 - protein, 11 aa, Artificial Sequence
  Synthetic
ARDSAPRIPAI

SEQ ID NO: 2476 - protein, 107 aa, Artificial Sequence
  Synthetic
DIQMTQSPSSLSASVGDRVTITCQASQDIRNYLNWYQQKPGKAPKLLIYDATNLKTGVPPRFSGGGSGTDFTFTISSLQPEDIATYYCQQYDNLPQTFGQGTKVEIK

SEQ ID NO: 2477 - protein, 9 aa, Artificial Sequence
  Synthetic
QQYDNLPQT

SEQ ID NO: 2478 - protein, 125 aa, Artificial Sequence
  Synthetic
QVQLVQSGAEVKKPGSSVKVSCKASGGTFSSYAISWVRQAPGQGLEWMGRIIPILGIAIYARKFQGRVTITADKSTSTAYMELSSLRSEDTAVYYCASTIAVADIRTLGYYFDYWGQGTLVTVSS

SEQ ID NO: 2479 - protein, 18 aa, Artificial Sequence
  Synthetic
ASTIAVADIRTLGYYFDY

SEQ ID NO: 2480 - protein, 106 aa, Artificial Sequence
  Synthetic
EIVMTQSPATLSVSPGERATLSCRASQSVSNNLAWYQQKPGQAPGLLIYGASTRATGIPARFGGSGSGTEFTLTISSLQSEDFAVYYCQQYNNWLTFGGGTKVEIK

SEQ ID NO: 2481 - protein, 8 aa, Artificial Sequence
  Synthetic
QQYNNWLT

SEQ ID NO: 2482 - protein, 125 aa, Artificial Sequence
  Synthetic
QVQLVQSGAEVKKPGSSVKVSCKASGGTFSSYAISWVQQAPGQGLEWMGRIIPILGIAIYAQKFQGRVTITADKSTGTAFMELDSLRSEDTAVYYCASTIAVAGIRTLGYYFDSWGQGTLVTVSS

SEQ ID NO: 2483 - protein, 18 aa, Artificial Sequence
  Synthetic
ASTIAVAGIRTLGYYFDS

SEQ ID NO: 2484 - protein, 106 aa, Artificial Sequence
  Synthetic
EIVMTQSPATLSVSPGERATLSCRASQNVSSNLAWYQQKPGQAPRLLIYGASTRATGIPARFSGSGSGTEFTLTISSLQSEDFAVYYCQQYNNWLTFGGGTKVEIK

SEQ ID NO: 2485 - protein, 8 aa, Artificial Sequence
  Synthetic
QQYNNWLT

SEQ ID NO: 2486 - protein, 124 aa, Artificial Sequence
  Synthetic
QVQLVQSGAEVKKPGSSVKVSCKTSGDTFSNYAITWVRQAPGQGLEYMGRIIPILGIPNSAQKFQGRVTITADKSTSTAYMELSSLRSDDTAVYYCATPMVRGVTPSINVFDIWGQGTMVTVSS

SEQ ID NO: 2487 - protein, 17 aa, Artificial Sequence
  Synthetic
ATPMVRGVTPSINVFDI

SEQ ID NO: 2488 - protein, 106 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNWITFGQGTRLEIK

SEQ ID NO: 2489 - protein, 8 aa, Artificial Sequence
  Synthetic
QQYNNWIT

SEQ ID NO: 2490 - protein, 117 aa, Artificial Sequence
  Synthetic
EVQLVESGGGLVQPGGSLRLSCAASGLTVSSNYMSWVRQAPGKGLEWVSVIYSGGSTFYADSVKGRFTISRDNSKNTLYLQMNSLRAEDTAVYYCARDLSYYGMDVWGQGTTVTVSS

SEQ ID NO: 2491 - protein, 11 aa, Artificial Sequence
  Synthetic
ARDLSYYGMDV

SEQ ID NO: 2492 - protein, 108 aa, Artificial Sequence
  Synthetic
DIQLTQSPSFLSASVGDRVTITCRASQGISNYLAWYQQKPGKAPKLLIYAASTLQSGVPSRFSGSGSGTDFTLTISSLQPEDFATYYCQQVNSYPPDTFGQGTKLEIK

SEQ ID NO: 2493 - protein, 10 aa, Artificial Sequence
  Synthetic
QQVNSYPPDT

SEQ ID NO: 2494 - protein, 123 aa, Artificial Sequence
  Synthetic
EVQLVESGGGSVQPGGSLRLSCAASGFTFSNYDMHWVRQVPGKGLEWVSAIGTAGDTYYPDSVKGRFTISRDNAKNSLYLQMHSLRAGDTAVYYCARGNLLRYFAGEYYFDYWGQGTLVTVSS

SEQ ID NO: 2495 - protein, 17 aa, Artificial Sequence
  Synthetic
ARGNLLRYFAGEYYFDY

SEQ ID NO: 2496 - protein, 108 aa, Artificial Sequence
  Synthetic
DIQMTQSPSSLSASVGDRVTITCRASQTINNFLNWYQQKPGKAPKLLIYAASTLQSGVPSRFSGRGSGTDYTLTISSLQPEDFATYSCQQSYSSPPWTFGQGTKVEIK

SEQ ID NO: 2497 - protein, 10 aa, Artificial Sequence
  Synthetic
QQSYSSPPWT

SEQ ID NO: 2498 - protein, 118 aa, Artificial Sequence
  Synthetic
EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDLGISGAFDIWGQGTMVTVSS

SEQ ID NO: 2499 - protein, 12 aa, Artificial Sequence
  Synthetic
ARDLGISGAFDI

SEQ ID NO: 2500 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLDSYSALTFGGGTKVEIK

SEQ ID NO: 2501 - protein, 10 aa, Artificial Sequence
  Synthetic
QQLDSYSALT

SEQ ID NO: 2502 - protein, 118 aa, Artificial Sequence
  Synthetic
EVQLVESGGGLVQPGGSLRLSCAASGLTVSSNYMTWVRQAPGKGLEWVSVIYPGGSKYYADSVKGRFSISRDNSKNTLYLQMNTLRSEDTAVYYCARDLDIVGAIDVWGQGTLVTVSS

SEQ ID NO: 2503 - protein, 12 aa, Artificial Sequence
  Synthetic
ARDLDIVGAIDV

SEQ ID NO: 2504 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLNSYPQYTFGQGTKLDIK

SEQ ID NO: 2505 - protein, 10 aa, Artificial Sequence
  Synthetic
QQLNSYPQYT

SEQ ID NO: 2506 - protein, 127 aa, Artificial Sequence
  Synthetic
QVQLVESGGGVVQPGRSLRLSCAGSGFTFSSYVMHWVRQAPGKGLEWVAVISYDGNNKYYADSVKGRFTISRDNSKNTLYLQMNSLRAEDTAVYYCARVRGTFEMTIPHLFRYFNLWGRGTLVTVSS

SEQ ID NO: 2507 - protein, 20 aa, Artificial Sequence
  Synthetic
ARVRGTFEMTIPHLFRYFNL

SEQ ID NO: 2508 - protein, 113 aa, Artificial Sequence
  Synthetic
DIVMTQTPLSLPVTPGEPASISCRSSQSLLDSDDGNTYLDWYLQKPGQSPQLLIYTLSSRASGVPDRFSGSGSGTDFTLKISRVEAEDVGVYYCMQRLEFPWAFGQGTKLEIK

SEQ ID NO: 2509 - protein, 9 aa, Artificial Sequence
  Synthetic
MQRLEFPWA

SEQ ID NO: 2510 - protein, 127 aa, Artificial Sequence
  Synthetic
QVQLVESGGGVVQPGRSLRLSCTASGFTFSSHAMHWVRQAPGKGLEWVAVISYDGSNRYYADSVKGRFTISRDNSKNTLYLQMNSLRAEDTAVYYCARDHRYYDSSGYDGEVYFDYWGQGTLVTVSS

SEQ ID NO: 2511 - protein, 20 aa, Artificial Sequence
  Synthetic
ARDHRYYDSSGYDGEVYFDY

SEQ ID NO: 2512 - protein, 107 aa, Artificial Sequence
  Synthetic
AIQMTQSPSSLSASVGDRVTITCRASQGIRNDLAWYQQKAGKAPKLLIYAAFILQSGVPSRFSGSGSGTDFTLTISSLQPEDFATYYCLQDYNYPYTFGQGTKLEIK

SEQ ID NO: 2513 - protein, 9 aa, Artificial Sequence
  Synthetic
LQDYNYPYT

SEQ ID NO: 2514 - protein, 118 aa, Artificial Sequence
  Synthetic
EVQLVESGGGLIQLGGSLRLSCAASGFIVSSKYMRWVRQAPGKGLEWVSVIYSGGSTYYADSVKGRFTIARDNSKNTLYLQMNSLRAEDTAVYYCARDLMERGGLDYWGQGTLATVSS

SEQ ID NO: 2515 - protein, 12 aa, Artificial Sequence
  Synthetic
ARDLMERGGLDY

SEQ ID NO: 2516 - protein, 110 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYDSSPPLITFGQGTKLEIK

SEQ ID NO: 2517 - protein, 11 aa, Artificial Sequence
  Synthetic
QQYDSSPPLIT

SEQ ID NO: 2518 - protein, 120 aa, Artificial Sequence
  Synthetic
QVQLVESGGGLVKPGGSLRLSCAASGFTFSDYYMSWIRQAPGKGLEWVSYISSTSSYTNYADSVKGRFTISRDNAKNSLYLQMNSLRAEDTAVYYCARGVLGGTTSWDYWGQGTLVTVSS

SEQ ID NO: 2519 - protein, 13 aa, Artificial Sequence
  Synthetic
ARGVLGGTTSWDY

SEQ ID NO: 2520 - protein, 108 aa, Artificial Sequence
  Synthetic
DIQMTQSPSSLSASVGDRVTITCRASQSISRYLNWYQQKPGKAPKLLIYEASSLQSGVPSRFSGSGSGTDFTLTISSLQPEDFATYYCQQSYSTRSITFGQGTRLEIK

SEQ ID NO: 2521 - protein, 10 aa, Artificial Sequence
  Synthetic
QQSYSTRSIT

SEQ ID NO: 2522 - protein, 118 aa, Artificial Sequence
  Synthetic
EVQLVESGGGLVQPGGSLRLSCAASDFIVSRNYMTWVRQAPGKGLEWVSVIYSGGSTYYADSVKGRFTISRDNSKNTLYLQMNSLRAEDTAVYYCARDLAVAGGIDCWGQGTLVTVSS

SEQ ID NO: 2523 - protein, 12 aa, Artificial Sequence
  Synthetic
ARDLAVAGGIDC

SEQ ID NO: 2524 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSFPGYTFGQGTKLEIK

SEQ ID NO: 2525 - protein, 10 aa, Artificial Sequence
  Synthetic
QQLNSFPGYT

SEQ ID NO: 2526 - protein, 118 aa, Artificial Sequence
  Synthetic
EVQLVESGGGLVQPGGSLRLSCAASEITVSRNYMSWVRQAPGKGLEWVSVIYSGGSTYYADSVKGRFTISRDNSKNTLYLQMNSLRAEDTAVYYCARYLGQQGNFDYWGQGTLVTVSS

SEQ ID NO: 2527 - protein, 12 aa, Artificial Sequence
  Synthetic
ARYLGQQGNFDY

SEQ ID NO: 2528 - protein, 107 aa, Artificial Sequence
  Synthetic
AIQMTQSPSSLSASVGDRVTITCRASQGIRNDLGWYQQKPGKAPKLLIYAASSLQSGVPSRFSGSGSGTDFTLTISSLQPEDFATYYCLQDSNYPITFGQGTRLEIK

SEQ ID NO: 2529 - protein, 9 aa, Artificial Sequence
  Synthetic
LQDSNYPIT

SEQ ID NO: 2530 - protein, 120 aa, Artificial Sequence
  Synthetic
QVQLVESGGGVVQPGRSLRLSCAASRFTFSNYAMHWVRQAPGKGLDWVAVISDDGNNKLYADSVKGRFTISRDNSKNTLYLQMNSLRAEDTAVYYCARDQGVMVTHFDYWGQGTLVTVSS

SEQ ID NO: 2531 - protein, 13 aa, Artificial Sequence
  Synthetic
ARDQGVMVTHFDY

SEQ ID NO: 2532 - protein, 108 aa, Artificial Sequence
  Synthetic
DIQMTQSPSSLSASVGDRVTITCRTSQSIRNYLNWYQQKPGKAPKLLIYDASSLQSGVPSRFSGSGSGTDFTLTISSLQPEDFATYYCQQSYNTPPWTFGQGTKVEIK

SEQ ID NO: 2533 - protein, 10 aa, Artificial Sequence
  Synthetic
QQSYNTPPWT

SEQ ID NO: 2534 - protein, 117 aa, Artificial Sequence
  Synthetic
EVQLVESGGGLVQPGGSLRLSCAASGFTVSSNYMSWVRQAPGKGLEWVSVIYSGGSTFYADSVKGRFTISRDNSKNVLHLQMNSLRVEDTAVYYCARDRGEDVFDYWGQGTLVTVSS

SEQ ID NO: 2535 - protein, 11 aa, Artificial Sequence
  Synthetic
ARDRGEDVFDY

SEQ ID NO: 2536 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLNGYPPTFGQGTKVEIK

SEQ ID NO: 2537 - protein, 9 aa, Artificial Sequence
  Synthetic
QQLNGYPPT

SEQ ID NO: 2538 - protein, 117 aa, Artificial Sequence
  Synthetic
EVQLVESGGGLVQPGGSLRLSCAASTFTVSSNYMSWVRQAPGKGLEWVSVIYSGGSTFYADSVKGRFTISRDNSKNTLYLQMNSLRAEDTAVYYCARDYGDLYFDYWGQGTLVTVSS

SEQ ID NO: 2539 - protein, 11 aa, Artificial Sequence
  Synthetic
ARDYGDLYFDY

SEQ ID NO: 2540 - protein, 108 aa, Artificial Sequence
  Synthetic
EIVLTQSPGTLSLSPGERATLSCRASQSVGSSYLAWYQQKPGQAPRLLIYGASSRATGIPDRFSGSGSGTDFTLTISRLEPEDFAVYYCQQYGSSPRTFGQGTKVEIK

SEQ ID NO: 2541 - protein, 9 aa, Artificial Sequence
  Synthetic
QQYGSSPRT

SEQ ID NO: 2542 - protein, 124 aa, Artificial Sequence
  Synthetic
EVQLVQSGAEVKKPGESLRISCKGSGYIFTNYWISWVRQMPGKGLEWMGRIDPSDSYTNYSPSFQGHVTISADKSISTAYLQWSSLKASDTAIYYCARDQYYYDSSGQIRFDPWGQGTLVTVSS

SEQ ID NO: 2543 - protein, 17 aa, Artificial Sequence
  Synthetic
ARDQYYYDSSGQIRFDP

SEQ ID NO: 2544 - protein, 107 aa, Artificial Sequence
  Synthetic
DIQMTQSPSTLSASVGDRVTITCRASQSISSWLAWYQQKPGKAPKVLIYKASSLESGVPSRFSGSGSGTEFTLTISSLQPDDFATYYCQHYNSYSRTFGQGTKVEIK

SEQ ID NO: 2545 - protein, 9 aa, Artificial Sequence
  Synthetic
QHYNSYSRT

SEQ ID NO: 2546 - protein, 117 aa, Artificial Sequence
  Synthetic
EVQLVESGGGLVQPGGSLRLSCAASGFIVSRNYMSWVRQAPGKGLEWVSVIYPGGSTYYGDSVKGRFTISRDNSKNTLYLQMNSLRAEDTAVYYCARDYGDYYFDYWGQGTLVTVSS

SEQ ID NO: 2547 - protein, 11 aa, Artificial Sequence
  Synthetic
ARDYGDYYFDY

SEQ ID NO: 2548 - protein, 107 aa, Artificial Sequence
  Synthetic
EIVLTQSPGTLSLSPGERATLSCRASQSVSSYLAWYQQKPGQAPRLLIYGASSRATGIPDRFSGSGSGTDFTLTISRLEPEDFAVYYCQQYGSSPRTFGQGTKVEIK

SEQ ID NO: 2549 - protein, 9 aa, Artificial Sequence
  Synthetic
QQYGSSPRT

SEQ ID NO: 2550 - protein, 123 aa, Artificial Sequence
  Synthetic
QVQLVQSGAEVKKPGASVKVSCKASGYTFTSYGISWVRQAPGQGLEWMGWINTYNGDINYAQKFQGRVTMTTDTSTSTAYMELRSLRSDDTAVFYCARGNGYTSGWTRGGDYWGQGTLVTVSS

SEQ ID NO: 2551 - protein, 16 aa, Artificial Sequence
  Synthetic
ARGNGYTSGWTRGGDY

SEQ ID NO: 2552 - protein, 109 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRWTFGQGTKVEIK

SEQ ID NO: 2553 - protein, 10 aa, Artificial Sequence
  Synthetic
QQYGSSPRWT

SEQ ID NO: 2554 - protein, 118 aa, Artificial Sequence
  Synthetic
EVQLVESGGGLIQPGGSLRLSCAASEFIVSRNYMTWVRQDPGKGLEWVSTMYSGGSTYYADSVKGRFTISRDNSRNTLYLQMNSLRAEDTAVYYCARDLMERGGLDYWGQGTLVTVSS

SEQ ID NO: 2555 - protein, 12 aa, Artificial Sequence
  Synthetic
ARDLMERGGLDY

SEQ ID NO: 2556 - protein, 110 aa, Artificial Sequence
  Synthetic
EIVLTQSPGTLSLSPGERATLSCRASQSISSSFLAWYQQKPGQAPRLLIYGASSRATGIPDRFSGSGSGTDFTLTISRLEPEDFAVYYCQQYGSSPPLITFGQGTKLEIK

SEQ ID NO: 2557 - protein, 11 aa, Artificial Sequence
  Synthetic
QQYGSSPPLIT

SEQ ID NO: 2558 - protein, 125 aa, Artificial Sequence
  Synthetic
QVQLVQSGAEVKKPGASVKVSCKASGYSFTRYYLHWVRQAPGQGPEWMGWINPNSGDIKYAQKFQGRVTMNRDTFINTVYMELSNLRSDDTAVYYCAKNQGAYYSSGFDDALDIWGQGTMVTVSS

SEQ ID NO: 2559 - protein, 18 aa, Artificial Sequence
  Synthetic
AKNQGAYYSSGFDDALDI

SEQ ID NO: 2560 - protein, 107 aa, Artificial Sequence; identical to SEQ ID NO: 118
  Synthetic

SEQ ID NO: 2561 - protein, 9 aa, Artificial Sequence
  Synthetic
QQYDNLPIT

SEQ ID NO: 2562 - protein, 120 aa, Artificial Sequence
  Synthetic
QVQLVESGGGVVQPGRSLRLSCAASGFTFSSYAMHWVRQTPGKGLEWVAVILYDGSNKYYADSVKGRFTISRDNSKNTLYLQMNSLRAEDTAVYYCARDQGVVVTHFDYWGQGTLVTVSS

SEQ ID NO: 2563 - protein, 13 aa, Artificial Sequence
  Synthetic
ARDQGVVVTHFDY

SEQ ID NO: 2564 - protein, 108 aa, Artificial Sequence
  Synthetic
DIQMTQSPVSLSASVGDRVTITCRASQSISSYLNWYQQKQGKAPKLLIYVASSLQSGVPSRFSGSGSGTDFTLTISSLQPEDFATYYCQQSYSTPPWTFGQGTKVEIK

SEQ ID NO: 2565 - protein, 10 aa, Artificial Sequence
  Synthetic
QQSYSTPPWT

SEQ ID NO: 2566 - protein, 123 aa, Artificial Sequence
  Synthetic
QVQLVESGGGVVQPGRSLRLSCAASGFSFSSYPMHWVRQAPGKGLEWVTFISYDGSNEYYADSVKGRFTISRDNSKNTLYLQMNSLRAEDTAVYYCARVGTMVRGVPPWFDPWGQGTLVTVSS

SEQ ID NO: 2567 - protein, 16 aa, Artificial Sequence
  Synthetic
ARVGTMVRGVPPWFDP

SEQ ID NO: 2568 - protein, 109 aa, Artificial Sequence
  Synthetic
DIQMTQSPSSLSASVGDRVTITCRASQSISNYLNWYQQKSGKAPKLLIYAASTLKDGVPSRFSGSGSGTDFTLTISSLQPEDFATYYCQQSYSTPPMYTFGQGTKLEIK

SEQ ID NO: 2569 - protein, 11 aa, Artificial Sequence
  Synthetic
QQSYSTPPMYT

SEQ ID NO: 2570 - protein, 117 aa, Artificial Sequence
  Synthetic
EVQLVESGGGLMQPGGSLRLSCAASGLTVSSNYMSWVRQAPGKGLEWVSIIYSGGSTFYADSVKGRFTISRDHSKNTLYLQMNTLRAEDTAVYYCARDLYYYGMDVWGQGTTVTVSS

SEQ ID NO: 2571 - protein, 11 aa, Artificial Sequence
  Synthetic
ARDLYYYGMDV

SEQ ID NO: 2572 - protein, 106 aa, Artificial Sequence
  Synthetic
DIQLTQSPSFLSASVGDRVTIACRASQGISSYLAWYQQKPGKAPKLLIYAASTLQSGVPSRFSGSGSGTEFTLTISSLQPEDFATYYCQQINDYPAFGQGTKVEIK

SEQ ID NO: 2573 - protein, 8 aa, Artificial Sequence
  Synthetic
QQINDYPA

SEQ ID NO: 2574 - protein, 128 aa, Artificial Sequence
  Synthetic
EVQLVESGGGLVQPGRSLRLSCTASGFTFGDYPMNWFRQAPGKGLDWVGFIRSKAYGGTTQYAASVRGRFTISRDDSKSIAYLQMSSLKTEDTAVYYCTRVVLPTAINDVRGYYFDYWGQGTLVTVSS

SEQ ID NO: 2575 - protein, 19 aa, Artificial Sequence
  Synthetic
TRVVLPTAINDVRGYYFDY

SEQ ID NO: 2576 - protein, 106 aa, Artificial Sequence
  Synthetic
EIVMTQSPATLSVSPGERATLSCRASQSVSSNLAWYQQKPGQTPRLLIFGASTRATGIPARFSGSGSGTEFTLTISSLQSEDFAVYYCQQYNNWFTFGGGTKVEIK

SEQ ID NO: 2577 - protein, 8 aa, Artificial Sequence
  Synthetic
QQYNNWFT

SEQ ID NO: 2578 - protein, 118 aa, Artificial Sequence
  Synthetic
EVQLVESGGGLVQPGGSLRLSCAASGITVSSNYMTWVRQAPGKGLEWVSVIYSGGSTYYADSVKGRFTISRDNSKNTLYLQMNSLRAEDTAVYFCARDLEIAGAFDIWGQGTMVTVSS

SEQ ID NO: 2579 - protein, 12 aa, Artificial Sequence
  Synthetic
ARDLEIAGAFDI

SEQ ID NO: 2580 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLNSYPALTFGGGTKVDIK

SEQ ID NO: 2581 - protein, 10 aa, Artificial Sequence
  Synthetic
QQLNSYPALT

SEQ ID NO: 2582 - protein, 121 aa, Artificial Sequence
  Synthetic
EVQLVESGGGLVQPGGSLRLSCSASGFTFSTYVMHWVRQAPGKGLEYVSSISSNGRITYYADSVKGRFTISRDNSKNTLYLQMSSLRPEDTAVYYCVKDMGVTSIDYFDYWGQGTLVTVSS

SEQ ID NO: 2583 - protein, 14 aa, Artificial Sequence
  Synthetic
VKDMGVTSIDYFDY

SEQ ID NO: 2584 - protein, 107 aa, Artificial Sequence
  Synthetic
DIQMTQSPSSLSASVGDRVTITCRASQSISRYLSWYQQKPGKAPKLLIYAASSLQIGVPSRFSGSGSGTDFTLTITILQPEDFATYYCQQSYGTPYTFGQGTNLEIK

SEQ ID NO: 2585 - protein, 9 aa, Artificial Sequence
  Synthetic
QQSYGTPYT

SEQ ID NO: 2586 - protein, 118 aa, Artificial Sequence
  Synthetic
EVQLVESGGGLIQPGGSLRLSCAASGITVSSNYMSWVRQAPGKGLEWVSVIYSGGSTFYADSVKGRFTISRDNSKNTLYLQMNSLRAEDTAVYYCARDLQESGGFDIWGQGTMVTVSS

SEQ ID NO: 2587 - protein, 12 aa, Artificial Sequence
  Synthetic
ARDLQESGGFDI

SEQ ID NO: 2588 - protein, 108 aa, Artificial Sequence
  Synthetic
EIVLTQSPGTLSLSPGERATLSCRASQSVSSRYLAWYQQKPGQAPRLLIYGASSRATGIPDRFSGSGSGTDFTLTISRLEPEDFAVYYCQQYGSSFVTFGQGTKLEIK

SEQ ID NO: 2589 - protein, 9 aa, Artificial Sequence
  Synthetic
QQYGSSFVT

SEQ ID NO: 2590 - protein, 120 aa, Artificial Sequence
  Synthetic
QVQLVESGGGVVQPGRSLRLSCAASGFTFSNYGMHWVRQAPGKGPEWVAVMSYDGSYKDYTDSVKGRFTISRDNSKNTLYLQMNSLRAEDTAVYYCARDYGDLVTYFDYWGQGTLVTVSS

SEQ ID NO: 2591 - protein, 13 aa, Artificial Sequence
  Synthetic
ARDYGDLVTYFDY

SEQ ID NO: 2592 - protein, 108 aa, Artificial Sequence
  Synthetic
DIQMTQSPSSLSALVGDRVTITCRASQSISSYLNWYQQKPGKAPKLLIYTASSLQSGVPSRFSGSGSGTDFTLTISSLQPEDFATYYCQQSYNTPPWTFGQGTKVEIK

SEQ ID NO: 2593 - protein, 10 aa, Artificial Sequence
  Synthetic
QQSYNTPPWT

SEQ ID NO: 2594 - protein, 128 aa, Artificial Sequence
  Synthetic
EVQLVESGGGLVQPGRSLRLSCTASGFTFGDYAMSWFRQAPGKGLEWVGFIRSKAYGGTTQYAASVKGRFTISRDDSKSIAYLQMSSLKTEDTAVYYCTRVVLPTAINDVRGYYFDYWGQGTLVTVSS

SEQ ID NO: 2595 - protein, 19 aa, Artificial Sequence
  Synthetic
TRVVLPTAINDVRGYYFDY

SEQ ID NO: 2596 - protein, 106 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNWFTFGGGTKVEIK

SEQ ID NO: 2597 - protein, 8 aa, Artificial Sequence
  Synthetic
QQYNNWFT

SEQ ID NO: 2598 - protein, 127 aa, Artificial Sequence
  Synthetic
QVQLVESGGGVVQPGRSLRVSCAGSGFTFSSYAMHWVRQAPGKGLEWVAVISYDGSNKYYADSVKGRFTISRDNSKNTLYLQMNSLRAEDTAVYYCARDGRTITLVRGVIDSPFDYWGQGTLVTVSS

SEQ ID NO: 2599 - protein, 20 aa, Artificial Sequence
  Synthetic
ARDGRTITLVRGVIDSPFDY

SEQ ID NO: 2600 - protein, 107 aa, Artificial Sequence
  Synthetic
DIQMTQSPSSLSASVGDRVTITCQASQDISNYLNWYQQKPGKAPKLLIYDASILETGVPSTFSGSGSGTDFTFTISSLQPEDIATYYCQQYDNLPPTFGQGTRLEIK

SEQ ID NO: 2601 - protein, 9 aa, Artificial Sequence
  Synthetic
QQYDNLPPT

SEQ ID NO: 2602 - protein, 117 aa, Artificial Sequence
  Synthetic
EVQLVESGGGLIQPGGSLRLSCAASGLTVSSNYMRWVRQAPGKGLEWVSVIYSGGSTYYADSVKGRFTISRDNSKNTLYLQMNSLRAEDTAVYYCARDLVVRGVDYWGQGTLVTVSS

SEQ ID NO: 2603 - protein, 11 aa, Artificial Sequence
  Synthetic
ARDLVVRGVDY

SEQ ID NO: 2604 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQELNSYPITFGQGTRLEIK

SEQ ID NO: 2605 - protein, 9 aa, Artificial Sequence
  Synthetic
QELNSYPIT

SEQ ID NO: 2606 - protein, 127 aa, Artificial Sequence
  Synthetic
QVQLQESGPGLVKPSETLSLTCTVSGGSISGNYWSWIRQPAGKGLEWIGRIYASGSTNYNPSLKSRLTMSVDTSKNQFSLKLSSVTAADTAVYYCAGSFRYNYDYSDYYSLDPFDYWGQGTLVTVSS

SEQ ID NO: 2607 - protein, 21 aa, Artificial Sequence
  Synthetic
AGSFRYNYDYSDYYSLDPFDY

SEQ ID NO: 2608 - protein, 107 aa, Artificial Sequence
  Synthetic
DIQLTQSPSFLSASVGDRVTITCRASQGINGYLAWYQQKPGKAPKLLIYATSTLQTGVPSRFSGSGSGTEFTLTISSLQPEDFATYYCQQLNSYLFTFGPGTKVDIK

SEQ ID NO: 2609 - protein, 9 aa, Artificial Sequence
  Synthetic
QQLNSYLFT

SEQ ID NO: 2610 - protein, 127 aa, Artificial Sequence
  Synthetic
QVQLVESGGGVVQPGRSLRLSCGASGFTFSSYALHWVRQAPGKGLEWVAVISYDGSNKYYVDSVKGRFTISRDNSKNTLYLQMNSLRAEDTAVYYCARDGTTITMVRGIIGPLYDYWGQGTLVTVSS

SEQ ID NO: 2611 - protein, 20 aa, Artificial Sequence
  Synthetic
ARDGTTITMVRGIIGPLYDY

SEQ ID NO: 2612 - protein, 107 aa, Artificial Sequence
  Synthetic
DIQMTQSPSSLSASVRDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 2613 - protein, 9 aa, Artificial Sequence
  Synthetic
QQYDNLPIT

SEQ ID NO: 2614 - protein, 117 aa, Artificial Sequence
  Synthetic
QVQLVESGGGVVQPGRSLRLSCAASGFTFSDYAMHWVRQAPGKGLEWVAVISYDGSNKFYADSVKGRFTISRDNSKNTLYLQMSSLRADDTAVYFCARETLRSLDYWGQGTLVTVSS

SEQ ID NO: 2615 - protein, 10 aa, Artificial Sequence
  Synthetic
ARETLRSLDY

SEQ ID NO: 2616 - protein, 107 aa, Artificial Sequence
  Synthetic
DIQMTQSPSSLSASVGDRVTITCRASESIRTYLDWYQQKPGKAPKLLIYAASTLQNGVPSRFSGSGSGTDFTLTISSLQPEDFASYYCQQSYSPLFTFGPGTKVDIK

SEQ ID NO: 2617 - protein, 9 aa, Artificial Sequence
  Synthetic
QQSYSPLFT

SEQ ID NO: 2618 - protein, 121 aa, Artificial Sequence
  Synthetic
QVQLVQSGAEVKKPGASVKVSCKASGYTFTGYYMYWVRQAPGQGLEWMGWINPNSGGTNYAQKFQGRVTMTRDTSISTAYMELSRLRSDDTAVYYCASLVRSTSYEYFHHWGQGTLVTVSS

SEQ ID NO: 2619 - protein, 14 aa, Artificial Sequence
  Synthetic
ASLVRSTSYEYFHH

SEQ ID NO: 2620 - protein, 107 aa, Artificial Sequence
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPHTFGQGTKLEIK

SEQ ID NO: 2621 - protein, 9 aa, Artificial Sequence
  Synthetic
LQHNSYPHT

SEQ ID NO: 2622 - protein, 120 aa, Artificial Sequence
  Synthetic
EVQLLESGGGLVQPGGSLRLSCAASGFTFNNYAMSWVRQAPGKGLEWVSAISGSGAGTFYADSVKGRFTISRDNSKNTLYLQMNSLRAEDTAVYYCAKEALNADMYFDYWGQGTLVTVSS

SEQ ID NO: 2623 - protein, 13 aa, Artificial Sequence
  Synthetic
AKEALNADMYFDY

SEQ ID NO: 2624 - protein, 108 aa, Artificial Sequence
  Synthetic
DIQMTQSPSSLSASVGDRVTITCRASQSINRYLNWYQQKPGKAPKLLIYGASSLQSGVPSRFSGSGSGTDFTLTISSLQPEDFATYSCQQSYSAPPITFGQGTRLEIK

SEQ ID NO: 2625 - protein, 10 aa, Artificial Sequence
  Synthetic
QQSYSAPPIT

SEQ ID NO: 2626 - protein, 122 aa, Artificial Sequence
  Synthetic
QVQLVESGGGVVQPGRSLRLSCAASGFTFSTYAMHWVRQAPGKGLEWVAVISYDGGYKDYADSVKGRFTISRDNSKNTLYLQMNSLRPEDTAVYFCARDVKDTALVTWFDYWGQGTLVTVSS

SEQ ID NO: 2627 - protein, 15 aa, Artificial Sequence
  Synthetic
ARDVKDTALVTWFDY

SEQ ID NO: 2628 - protein, 108 aa, Artificial Sequence
  Synthetic
DIQMTQSPSSLSASVGDRVTITCRASQSISSYLNWYQQKPGKAPKLLIYLVSSLQSGVPSRFSGSGSGTDFTLTISSLQPEDFATYYCQQSYSTPPWTFGQGTKVEIK

SEQ ID NO: 2629 - protein, 10 aa, Artificial Sequence
  Synthetic
QQSYSTPPWT

SEQ ID NO: 2630 - protein, 131 aa, Artificial Sequence
  Synthetic
QVQLVQSGAEVKKPGASVRVSCKASGYTFSWYAIHWVRQAPGQRLEWMGWINAGNGNTKYSQKFQGRVTITRDTSATTAYMEMSSLRSEDTAVYYCARDLRYKSGHSGYDPRDYYYGMDVWGQGTTVTVSS

SEQ ID NO: 2631 - protein, 24 aa, Artificial Sequence
  Synthetic
ARDLRYKSGHSGYDPRDYYYGMDV

SEQ ID NO: 2632 - protein, 111 aa, Artificial Sequence
  Synthetic
DIVMTQSPLSLPVTPGEPASISCRSSQSLLHSNGYNYLDWYLQKPGQSPQLLIYLGSTRASGVPDRFSGSGSGTDFTLKISRVEAEDVGVYYCMQALQTWTFGQGTKVEIK

SEQ ID NO: 2633 - protein, 8 aa, Artificial Sequence
  Synthetic
MQALQTWT

SEQ ID NO: 2634 - protein, 131 aa, Artificial Sequence
  Synthetic
QVQLVQSGAEVKKPGSSVKVSCKASGGTFNSYAISWVRQAPGQGLEWMGGIIPIFGRANYAQKFQGRVTIIADESTSTVYMELSSLRSEDTAVYYCARVGAPLVRGLIDSSHFYYYGMDVWGQGTTVTVSS

SEQ ID NO: 2635 - protein, 24 aa, Artificial Sequence
  Synthetic
ARVGAPLVRGLIDSSHFYYYGMDV

SEQ ID NO: 2636 - protein, 112 aa, Artificial Sequence
  Synthetic
DIVMTQSPLSLPVTPGEPASISCRSSQSLLHSNGYNYLDWYLQKPGQSPQLLIYLASNRASGVPDRFSGSGSGTDFTLKISRVEAEDVGVYYCMQPLQTPPTFGPGTKVDIK

SEQ ID NO: 2637 - protein, 9 aa, Artificial Sequence
  Synthetic
MQPLQTPPT

SEQ ID NO: 2638 - protein, 121 aa, Artificial Sequence
  Synthetic
EVQLLESGGGLVQPGGSLRLSCAASGFTFSSYAMSWVRQAPGKGLEWVSTISGSGDTTYYADSVKGRFTISRDTSKNTLYLQMNTLRAEDTAVYYCAKDWSSGYGDYFDYWGQGTLVTVSS

SEQ ID NO: 2639 - protein, 14 aa, Artificial Sequence
  Synthetic
AKDWSSGYGDYFDY

SEQ ID NO: 2640 - protein, 108 aa, Artificial Sequence
  Synthetic
DIQMTQSPSSLSASVGDRVTITCRASQSISSYLNWYQQKPGKAPKLLIYAASNLQSGVPSRFSGSGSGTDFTLTISSLQPEDFATYYCQQSYNTPPNTFGQGTKVEIK

SEQ ID NO: 2641 - protein, 10 aa, Artificial Sequence
  Synthetic
QQSYNTPPNT

SEQ ID NO: 2642 - protein, 122 aa, Artificial Sequence
  Synthetic
QVQLVQSGAEVKKPGASVKVSCKASGYMFTSYYMHWVRQAPGQGLEWMGIINPSGGSISYAQKFQGRVTLTRDTSTSTVYMELSSLRYEDTAVYYCARDRGLVPAKNWFDPWGQGTLVTVSS

SEQ ID NO: 2643 - protein, 15 aa, Artificial Sequence
  Synthetic
ARDRGLVPAKNWFDP

SEQ ID NO: 2644 - protein, 109 aa, Artificial Sequence
  Synthetic
EIVLTQSPATLSLSPGERATLSCRASQSVSSYLAWYQQKPGQAPRLLIYDVSNRATGIPARFSGSGSGTDFTLTISSLEPEDCAVYYCQHRSNWPPMYTFGQGTKLEIK

SEQ ID NO: 2645 - protein, 11 aa, Artificial Sequence
  Synthetic
QHRSNWPPMYT

SEQ ID NO: 2646 - protein, 125 aa, Artificial Sequence
  Synthetic
QVQLQESGPGLVKPSQTLSLTCTVSGGSISSGDYYWSWIRQHPGKGLEWIGYIYYSGSTYYNPSLKSRVTISVDTSKNQFSLKLSSVTAADTAVYYCAREVRSSWYGATHYFDYWGQGTLVTVSS

SEQ ID NO: 2647 - protein, 17 aa, Artificial Sequence
  Synthetic
AREVRSSWYGATHYFDY

SEQ ID NO: 2648 - protein, 110 aa, Artificial Sequence
  Synthetic
QSVLTQPASVSGSPGQSITISCTGTSSDVGTYTLVSWYQQHPGKAPKLMIYEVSKRPSGVSNRFSGSKSGNTASLTISGLQAEDEADYYCCSYAGSSTFLVFGGGTKLTL

SEQ ID NO: 2649 - protein, 11 aa, Artificial Sequence
  Synthetic
CSYAGSSTFLV

SEQ ID NO: 2650 - protein, 123 aa, Artificial Sequence
  Synthetic
EVQLVESGGGLVQPGGSLRLSCAASGFTFSSYTMNWVRQAPGKGLEWVSYISSSSSTIYYADSVKGRFTISRDNAKNSLYLQMNSLRDEDTAVYYCARDPPGIVGAGDYFDYWGQGTLVTVSS

SEQ ID NO: 2651 - protein, 16 aa, Artificial Sequence
  Synthetic
ARDPPGIVGAGDYFDY

SEQ ID NO: 2652 - protein, 109 aa, Artificial Sequence
  Synthetic
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDPLKVFGTGTKVTVL

SEQ ID NO: 2653 - protein, 12 aa, Artificial Sequence
  Synthetic
QVWDSSSDPLKV

SEQ ID NO: 2654 - protein, 120 aa, Artificial Sequence
  Synthetic
QVQLQESGPGLVKPSQTLSLTCTVSTGSISSGGYYWSWIRQHPGKGLEWIGHIHLSGSTDYNPSLKSRVSISLDTSKNHFSLKLSSVTAADTAIYYCASALGITYYFDYWGQGTLVTVSS

SEQ ID NO: 2655 - protein, 12 aa, Artificial Sequence
  Synthetic
ASALGITYYFDY

SEQ ID NO: 2656 - protein, 107 aa, Artificial Sequence
  Synthetic
QSVLTQPASVSGSPGQSITISCTGTSSDVGRYNYVSWYQQHPGKAPKLMIYDVSDRPSGVSNRFSGSKSDNTASLTISGLQAEDEADYYCSSYTSSSVVFGGRDQAD

SEQ ID NO: 2657 - protein, 9 aa, Artificial Sequence
  Synthetic
SSYTSSSVV

SEQ ID NO: 2658 - protein, 121 aa, Artificial Sequence
  Synthetic
EVQLVESGGGLVQPGRSLRLSCAASGFTFDDYAMHWVRQAPGKGLEWVSGISWNSGSRAYADSVKGRFTISRDNAKNSLYLQMNSLRAEDTAFYYCTKGSSASYEGWFDPWGQGTLVTVSS

SEQ ID NO: 2659 - protein, 14 aa, Artificial Sequence
  Synthetic
TKGSSASYEGWFDP

SEQ ID NO: 2660 - protein, 105 aa, Artificial Sequence
  Synthetic
SYVLTQPPSVSVAPGKTARVTCGGNSIGSKSVHWYQQKPGQAPVLVIFYDSDRPSGIPERFSGSNSGNTATLTISRVEAGDEADYFCQVWDTSVVFGGGTKLTVL

SEQ ID NO: 2661 - protein, 8 aa, Artificial Sequence
  Synthetic
QVWDTSVV

SEQ ID NO: 2662 - protein, 124 aa, Artificial Sequence
  Synthetic
QVQLQESGPGLVKPSQTLSLTCTVSGGSISSGDYYWSWIRQHPGKGLEWIGYIYYSGSTYYNPSLKSRVTISVDTSKNQFSLKLSSVTAADTAVYYCAREVRSSWYGATHYFDYWGQGTLVTVS

SEQ ID NO: 2663 - protein, 17 aa, Artificial Sequence
  Synthetic
AREVRSSWYGATHYFDY

SEQ ID NO: 2664 - protein, 111 aa, Artificial Sequence
  Synthetic
QSVLTQPASVSGSPGQSITISCTGTSSDVGTYTLVSWYQQHPGKAPKLMIYEVSKRPSGVSNRFSGSKSGNTASLTISGLQAEDEADYYCCSYAGSSTFLVFGGGTKLTVL

SEQ ID NO: 2665 - protein, 11 aa, Artificial Sequence
  Synthetic
CSYAGSSTFLV

SEQ ID NO: 2666 - protein, 127 aa, Artificial Sequence
  Synthetic
QVQLQESGPGLVKASQTLSLTCTVSGGSISSGGYHWSWIRQHPGKGLEWIGYIYYSGSTYYNPSLKSRVTISVDTSKNQFSLKLSSVTAADTAVYYCARFAAPGARATMIYSAFDIWGQGTMVTVSS

SEQ ID NO: 2667 - protein, 19 aa, Artificial Sequence
  Synthetic
ARFAAPGARATMIYSAFDI

SEQ ID NO: 2668 - protein, 109 aa, Artificial Sequence
  Synthetic
QSVLTQPASVSGSPGQSITISCTGTSSDVGGYNFVSWYQHHPGKAPKLMIYDVSDRPSGVSYRFSGSKSGNTASLTISGLQAEDEADYYCSSFTTSGTSFGGGTKLTVL

SEQ ID NO: 2669 - protein, 9 aa, Artificial Sequence
  Synthetic
SSFTTSGTS

SEQ ID NO: 2670 - protein, 120 aa, Artificial Sequence
  Synthetic
EVQLVESGGGLIQPGGSLRLSCAASGVTVSSNYMSWVRQAPGKGLEWVSVIYSGGSTFHADSVKGRFTISRDNSKNTLYLQMNSLRAEDTAVYYCARDLGTSGGYGMDVWGQGTTVTVSS

SEQ ID NO: 2671 - protein, 14 aa, Artificial Sequence
  Synthetic
ARDLGTSGGYGMDV

SEQ ID NO: 2672 - protein, 111 aa, Artificial Sequence
  Synthetic
QSVLTQPPSASGTPGQRVTISCSGSSSNIGSNYVYWYQQLPGTAPKLLIYRNNQRPSGVPDRFSGSKSGTSASLAISGLRSEDEADYSCAVWDDSLSVSLVFGTGTKVTVL

SEQ ID NO: 2673 - protein, 12 aa, Artificial Sequence
  Synthetic
AVWDDSLSVSLV

SEQ ID NO: 2674 - protein, 129 aa, Artificial Sequence
  Synthetic
EVQLVESGGGLVQPGRSLRLSCAASGFTFDDYAMHWVRQAPGKGLEWVSGMSWNSGTIGYADSVKGRFTISRDNAKNSLYLQMISLGAEDTALYYCAKDSSGGGRYYYDNTGPRAFDCWGQGTLVTVSS

SEQ ID NO: 2675 - protein, 22 aa, Artificial Sequence
  Synthetic
AKDSSGGGRYYYDNTGPRAFDC

SEQ ID NO: 2676 - protein, 108 aa, Artificial Sequence
  Synthetic
SYVLTQPPSVSEAPGKTARITCGGNNIGSKSVHWYQQKPGQAPELVVHDDSDRPSGIPERFSGSNSGNTATLTISRVEAGDEADYYCQVWDSSIDLVVFGGGTKLTVL

SEQ ID NO: 2677 - protein, 11 aa, Artificial Sequence
  Synthetic
QVWDSSIDLVV

SEQ ID NO: 2678 - protein, 141 aa, Artificial Sequence
  Synthetic
QVQLVQSGAEVKKPGSSVKVSCKASGGTFSSYAISWVRQAPGQGLEWMGGIIPIFGTANYAQKFQGRVTITADESTSTAYMELNSLRSEDTAVYYCATTGPDSSGYYYGRLPLTGGSGYYYGRLPILFDYWGQGTLVTVSS

SEQ ID NO: 2679 - protein, 34 aa, Artificial Sequence
  Synthetic
ATTGPDSSGYYYGRLPLTGGSGYYYGRLPILFDY

SEQ ID NO: 2680 - protein, 111 aa, Artificial Sequence
  Synthetic
QSVLTQPASVSGSPGQSITISCTGTSSDVGGYNYVSWYQQHPGKAPKLMIYDVSNRPSGVSNRFSASKSGNTASLTISGLQAEDEADYYCSSYTSSSTPVVFGGGTKLTVL

SEQ ID NO: 2681 - protein, 11 aa, Artificial Sequence
  Synthetic
SSYTSSSTPVV

SEQ ID NO: 2682 - protein, 125 aa, Artificial Sequence; identical to SEQ ID NO: 2646
  Synthetic

SEQ ID NO: 2683 - protein, 17 aa, Artificial Sequence
  Synthetic
AREVRSSWYGATHYFDY

SEQ ID NO: 2684 - protein, 111 aa, Artificial Sequence; identical to SEQ ID NO: 2664
  Synthetic

SEQ ID NO: 2685 - protein, 11 aa, Artificial Sequence
  Synthetic
CSYAGSSTFLV

SEQ ID NO: 2686 - protein, 124 aa, Artificial Sequence
  Synthetic
QVQLVQSGAEVKKPGSSVKVSCKASGGTFSSYPISWVRQAPGQGLEWMGGIIPIFGTANYAQKFQGRVTITADESTSTAYMELSSLKSEDTAVYYCARDRGYSSGGAAVNFDLWGRGTLVTVSS

SEQ ID NO: 2687 - protein, 17 aa, Artificial Sequence
  Synthetic
ARDRGYSSGGAAVNFDL

SEQ ID NO: 2688 - protein, 111 aa, Artificial Sequence
  Synthetic
QSVLTQPPSVSGAPGQRVTISCTGSNSNIGAGYDVHWYQKLPGTAPKLLIYGNSNRPSGVPDRFSGSKSGTSASLAITGLQAEDEADYYCQSYDSSLSAPVFGGGTKLTVL

SEQ ID NO: 2689 - protein, 11 aa, Artificial Sequence
  Synthetic
QSYDSSLSAPV

SEQ ID NO: 2690 - protein, 121 aa, Artificial Sequence
  Synthetic
EVQLLESGGGLVQPGGSLRLSCAASGFTFRSYAMSWVRQAPGKGLEWVSAISTSGGSPYYADSVKGRFTISRDNSKNTLYLQMNSLRAEDTALYYCAKDPSYRYGDYFDYWGQGTLVTVSS

SEQ ID NO: 2691 - protein, 14 aa, Artificial Sequence
  Synthetic
AKDPSYRYGDYFDY

SEQ ID NO: 2692 - protein, 104 aa, Artificial Sequence
  Synthetic
SYVLTQPPSVSVAPGKTARITCGGNNIGSKSVHWYQQKPGQAPVLVIYYDNDRPSGIPERFSGSNSGNTATLTISRVEAGDEADYYCQVWDTGVVFGGGTKLTV

SEQ ID NO: 2693 - protein, 8 aa, Artificial Sequence
  Synthetic
QVWDTGVV

SEQ ID NO: 2694 - protein, 127 aa, Artificial Sequence
  Synthetic
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDSMGYSSGWSHWGYYFEYWGQGTLVTVSS

SEQ ID NO: 2695 - protein, 20 aa, Artificial Sequence
  Synthetic
AKDSMGYSSGWSHWGYYFEY

SEQ ID NO: 2696 - protein, 112 aa, Artificial Sequence
  Synthetic
QSVLTQPPSVSGAPGQRVTISCTGSSSNIGAGYDVHWYQQLPGRAPKLLIYDNSNRPSGVPDRFSGSKSGTSASLAITGLQAEDEAGYYCQSYDSSLSGNVVFGGGTKLTVL

SEQ ID NO: 2697 - protein, 12 aa, Artificial Sequence
  Synthetic
QSYDSSLSGNVV

SEQ ID NO: 2698 - protein, 132 aa, Artificial Sequence
  Synthetic
QVQLVESGGGVVQPGRSLRLSCAASGFTFSSYAMHWVRQAPGKGLEWMAIISYDGSNKYYADSVRGRFTISRDNSKNTLYLQMNSLRAEDTAVYYCARDLAGYYESSGHWVWVRYQYGMDVWGQGTTVTVSS

SEQ ID NO: 2699 - protein, 25 aa, Artificial Sequence
  Synthetic
ARDLAGYYESSGHWVWVRYQYGMDV

SEQ ID NO: 2700 - protein, 110 aa, Artificial Sequence
  Synthetic
QSVLTQPPSVSAAPGQKVTISCSGINSNIGNNYVSWYQQLPGTAPKLLIYDNNKRPSGIPDRFSGSKSGTSATLGITGLQTGDEADYYCGTWDTSLSAWVFGGGTKLTVL

SEQ ID NO: 2701 - protein, 11 aa, Artificial Sequence
  Synthetic
GTWDTSLSAWV

SEQ ID NO: 2702 - protein, 124 aa, Artificial Sequence
  Synthetic
EVQLVESGGGLVQPGRSLRLSCVVSGFTFDDYAMHWVRQAPGKGLEWVAGISWNSDTKGYVDSVKGRFTISRDNAKKSLYLQMNSLRAEDTALYYCAKGGMYYYGSGSYSFDYWGQGTLVTVSS

SEQ ID NO: 2703 - protein, 17 aa, Artificial Sequence
  Synthetic
AKGGMYYYGSGSYSFDY

SEQ ID NO: 2704 - protein, 109 aa, Artificial Sequence
  Synthetic
QSVTQPPSASGTPGQRVTISCSGSSSNIGSNSVFWYQQLPGTAPKLLIYRDNLRPSGVPDRFSGSKSGTSASLAISGLRSEDEADYYCAAWDDSLSGHVFGTGTKVTVL

SEQ ID NO: 2705 - protein, 11 aa, Artificial Sequence
  Synthetic
AAWDDSLSGHV

SEQ ID NO: 2706 - protein, 131 aa, Artificial Sequence
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGDVWYYDSSGSIRAHVGDAFHIWGQGTMVTVSS

SEQ ID NO: 2707 - protein, 24 aa, Artificial Sequence
  Synthetic
ARGDVWYYDSSGSIRAHVGDAFHI

SEQ ID NO: 2708 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSNVFGTGTKVTV

SEQ ID NO: 2709 - protein, 12 aa, Artificial Sequence
  Synthetic
QSYDSSLSGSNV

SEQ ID NO: 2710 - protein, 122 aa, Artificial Sequence
  Synthetic
QVQLVQSGAEVKKPGASVKVSCKASGYTFTGYYMHWVRQAPGQGLEWMGWINPNSGGTNYAQKFQGRVTMTRDTSITTAYMELSRLRSDDTAVYYCARDLLYSRLGWYFDLWGRGTLVTVSS

SEQ ID NO: 2711 - protein, 15 aa, Artificial Sequence
  Synthetic
ARDLLYSRLGWYFDL

SEQ ID NO: 2712 - protein, 110 aa, Artificial Sequence
  Synthetic
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGVVFGGGTKLTVL

SEQ ID NO: 2713 - protein, 11 aa, Artificial Sequence
  Synthetic
AAWDDSLSGVV

SEQ ID NO: 2714 - protein, 124 aa, Artificial Sequence; identical to SEQ ID NO: 2702
  Synthetic

SEQ ID NO: 2715 - protein, 17 aa, Artificial Sequence
  Synthetic
AKGGMYYYGSGSYSFDY

SEQ ID NO: 2716 - protein, 110 aa, Artificial Sequence
  Synthetic
QSVLTQPPSASGTPGQRVTISCSGSSSNIGSNSVFWYQQLPGTAPKLLIYRDNLRPSGVPDRFSGSKSGTSASLAISGLRSEDEADYYCAAWDDSLSGHVFGTGTKVTVL

SEQ ID NO: 2717 - protein, 11 aa, Artificial Sequence
  Synthetic
AAWDDSLSGHV

SEQ ID NO: 2718 - protein, 131 aa, Artificial Sequence
  Synthetic
QVQLQQWGAGLLKPSETLSLTCAVYGGSFSGYYWNWIRQPPGKGLEWIGEINHSGSTNYNPSLKSRVTISVDTSKNQFSLKLSSVTAADTAVYYCARGNPIHPHDNCSGGSCYPPYFFDYWGQGTLVTVSS

SEQ ID NO: 2719 - protein, 25 aa, Artificial Sequence
  Synthetic
ARGNPIHPHDNCSGGSCYPPYFFDY

SEQ ID NO: 2720 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 2721 - protein, 11 aa, Artificial Sequence
  Synthetic
QSYDSSLSGSV

SEQ ID NO: 2722 - protein, 129 aa, Artificial Sequence
  Synthetic
QVQLQQWGAGLLKPSETLSLTCAVYGGSFSGYYWSWIRQPPGKGLEWIGEIHHSGSTNYNPSLKSRVTISVDTSKNQFSLKLSSVTAADTAVYFCARGDCSGGTCYSGGENYYYGMDVWGQGTTVTVSS

SEQ ID NO: 2723 - protein, 23 aa, Artificial Sequence
  Synthetic
ARGDCSGGTCYSGGENYYYGMDV

SEQ ID NO: 2724 - protein, 112 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSRVFGGGTKLTVL

SEQ ID NO: 2725 - protein, 12 aa, Artificial Sequence
  Synthetic
QSYDSSLSGSRV

SEQ ID NO: 2726 - protein, 125 aa, Artificial Sequence
  Synthetic
QVQLQESGPGLVKPSQTLSLTCTVSGGSIGSGDYYWSWIRQHPGKGLEWIGFIYYSGSTYYNPSLKSRVTISVDTSKNQLSLKLSSVTAADTAVYYCAREVRSSWYGATHYFDYWGQGTLVTVSS

SEQ ID NO: 2727 - protein, 17 aa, Artificial Sequence
  Synthetic
AREVRSSWYGATHYFDY

SEQ ID NO: 2728 - protein, 110 aa, Artificial Sequence
  Synthetic
QSVLTQPASVSGSPGQSITISCTGTSSDVGTYTLVSWYQFHPGKAPKLMIYEVSKRPSGVYNRFSGSKFGNTASLTIGLQAEDEADYYCCSYAGSSTFLVFGGGTKLTVL

SEQ ID NO: 2729 - protein, 11 aa, Artificial Sequence
  Synthetic
CSYAGSSTFLV

SEQ ID NO: 2730 - protein, 122 aa, Artificial Sequence
  Synthetic
QVQLVQSGAEVKKPGASVKVSCKASGYTFTGYYMHWVRQAPGQGLEWMGWINPNSGGTNYAQKFQGRVTMTRDTSIITAYMELSRLRSDDTAVYYCARDASWSVVRGAPDYWGQGTLVTVSS

SEQ ID NO: 2731 - protein, 15 aa, Artificial Sequence
  Synthetic
ARDASWSVVRGAPDY

SEQ ID NO: 2732 - protein, 110 aa, Artificial Sequence; identical to SEQ ID NO: 2320
  Synthetic

SEQ ID NO: 2733 - protein, 10 aa, Artificial Sequence
  Synthetic
SSYAGSNNWV

SEQ ID NO: 2734 - protein, 122 aa, Artificial Sequence
  Synthetic
QVQLVQSGAEVKKPGSSVKVSCKASGVIFSSYNISWVRQAPGQGLEWMGGIIPIIGTAIYAQKFQDRVTITADESTRTAYMELSSLRSEDTAIYFCARAPPSGSTDYYFDYWDQGTLVTVSS

SEQ ID NO: 2735 - protein, 15 aa, Artificial Sequence
  Synthetic
ARAPPSGSTDYYFDY

SEQ ID NO: 2736 - protein, 106 aa, Artificial Sequence
  Synthetic
SYVLTQPPSVSVAPGKTARITCGGSNIGSKNVHWYQQRPGQAPVLVIYYDGDRPSGIPERFSGSNSGNTATLTISRVEAGDEADYFCQVWDSSSDHLVFGGGTKLT

SEQ ID NO: 2737 - protein, 11 aa, Artificial Sequence
  Synthetic
QVWDSSSDHLV

SEQ ID NO: 2738 - protein, 123 aa, Artificial Sequence
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARERLAAAGTAEYFQHWGQGTLVTVSS

SEQ ID NO: 2739 - protein, 16 aa, Artificial Sequence
  Synthetic
ARERLAAAGTAEYFQH

SEQ ID NO: 2740 - protein, 110 aa, Artificial Sequence
  Synthetic
QSVLTQPPSASGTPGQRVTISCSGSSSNIGSNTVNWYQQLPGTAPKLLIYGNNQRPSGVPDRFSGSKSGTSASLAISGLQSEDEADYYCAAWDDSLNGVVFGGGTKLTVL

SEQ ID NO: 2741 - protein, 11 aa, Artificial Sequence
  Synthetic
AAWDDSLNGVV

SEQ ID NO: 2742 - protein, 122 aa, Artificial Sequence; identical to SEQ ID NO: 2710
  Synthetic

SEQ ID NO: 2743 - protein, 15 aa, Artificial Sequence
  Synthetic
ARDLLYSRLGWYFDL

SEQ ID NO: 2744 - protein, 110 aa, Artificial Sequence; identical to SEQ ID NO: 2712
  Synthetic

SEQ ID NO: 2745 - protein, 11 aa, Artificial Sequence
  Synthetic
AAWDDSLSGVV

SEQ ID NO: 2746 - protein, 125 aa, Artificial Sequence; identical to SEQ ID NO: 2646
  Synthetic

SEQ ID NO: 2747 - protein, 17 aa, Artificial Sequence
  Synthetic
AREVRSSWYGATHYFDY

SEQ ID NO: 2748 - protein, 111 aa, Artificial Sequence; identical to SEQ ID NO: 2664
  Synthetic

SEQ ID NO: 2749 - protein, 11 aa, Artificial Sequence
  Synthetic
CSYAGSSTFLV

SEQ ID NO: 2750 - protein, 126 aa, Artificial Sequence
  Synthetic
EVQLVQSGAEVKKPGESLKISCKGSGYDFTKYWIGWVRQMPGKGLEWMGIIYPGDSDTRYSPSFQGQVTISADKSISTAYLQWTSLKASDTAMYYCATGHDDYCSLTACYQAFDYWGEGTLVTVSS

SEQ ID NO: 2751 - protein, 19 aa, Artificial Sequence
  Synthetic
ATGHDDYCSLTACYQAFDY

SEQ ID NO: 2752 - protein, 110 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDISLSAGVFGGGTKLTVL

SEQ ID NO: 2753 - protein, 11 aa, Artificial Sequence
  Synthetic
GTWDISLSAGV

SEQ ID NO: 2754 - protein, 119 aa, Artificial Sequence
  Synthetic
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARKRWLQGDFDYWGQGTLVTVSS

SEQ ID NO: 2755 - protein, 12 aa, Artificial Sequence
  Synthetic
ARKRWLQGDFDY

SEQ ID NO: 2756 - protein, 110 aa, Artificial Sequence
  Synthetic
NFMLTQPHSVSESPGKTVTISCTRSSGSIASNYVQWYRQRPGSAPTTVIYEDNQRPSGVPDRFSGSIDSSSNSASLTISGLKTEDEADYYCQSYDSSNHGVFGGGTKLTV

SEQ ID NO: 2757 - protein, 10 aa, Artificial Sequence
  Synthetic
QSYDSSNHGV

SEQ ID NO: 2758 - protein, 120 aa, Artificial Sequence
  Synthetic
QVQLQESGPGLVKPSQTLSLTCTVSGGSISSGGYYWSWIRQLPGKGLEWIGHIYHSGSTDYNPSLKSRVTISVDTSKNQFSLKLSSVTAADTAVYYCASTLGITYYFDYWGQGTLVTVSS

SEQ ID NO: 2759 - protein, 12 aa, Artificial Sequence
  Synthetic
ASTLGITYYFDY

SEQ ID NO: 2760 - protein, 109 aa, Artificial Sequence
  Synthetic
QSVLTQPASVSGSPGQSITISCTGTSSDVGGYNYVSWYQQHPGKAPKLMIYDVSNRPSGVSNRFSGSKSGNTASLTISGLQAEDEADYYCSSYTISSVVFGGGTKLTVL

SEQ ID NO: 2761 - protein, 9 aa, Artificial Sequence
  Synthetic
SSYTISSVV

SEQ ID NO: 2762 - protein, 131 aa, Artificial Sequence
  Synthetic
QVQLVQSGAEVKKPGASVKVSCKASGYTFTSYGISWVRQAPGQGLEWMGWITAYNGNTNYAQNLQGRVTMTTDTSTSTAYMELRSLRSDDTAVYYCARDLGREYDSSGYSYKYYYYGMDVWGQGTTVTVSS

SEQ ID NO: 2763 - protein, 22 aa, Artificial Sequence
  Synthetic
ARDGRYDSSGYSYKYYYYGMDV

SEQ ID NO: 2764 - protein, 110 aa, Artificial Sequence
  Synthetic
QSVLTQPPSASGSPGQSVTISCTGTSSDVGGYNYVSWYQQHPGKAPKLMIYEVTKRPSGVPDRFSGSKSGNTASLTVSGLQAEDEADYYCSSYAGSNNLVFGGGTKLTVL

SEQ ID NO: 2765 - protein, 10 aa, Artificial Sequence
  Synthetic
SSYAGSNNLV

SEQ ID NO: 2766 - protein, 125 aa, Artificial Sequence; identical to SEQ ID NO: 2646
  Synthetic

SEQ ID NO: 2767 - protein, 17 aa, Artificial Sequence
  Synthetic
AREVRSSWYGATHYFDY

SEQ ID NO: 2768 - protein, 111 aa, Artificial Sequence; identical to SEQ ID NO: 2664
  Synthetic

SEQ ID NO: 2769 - protein, 11 aa, Artificial Sequence
  Synthetic
CSYAGSSTFLV

SEQ ID NO: 2770 - protein, 125 aa, Artificial Sequence; identical to SEQ ID NO: 2646
  Synthetic

SEQ ID NO: 2771 - protein, 17 aa, Artificial Sequence
  Synthetic
AREVRSSWYGATHYFDY

SEQ ID NO: 2772 - protein, 111 aa, Artificial Sequence; identical to SEQ ID NO: 2664
  Synthetic

SEQ ID NO: 2773 - protein, 11 aa, Artificial Sequence
  Synthetic
CSYAGSSTFLV

SEQ ID NO: 2774 - protein, 119 aa, Artificial Sequence
  Synthetic
EVQLVESGGGLVQPGGSLRLSCAASGFTFSSYSMNWVRQAPGKGLEWVSYISSSSSAIYYADSVKGRFTISRDNAKNSLYLQMNSLRDEDTAVYYCATLGWLRGSFDYWGQGTLVTVSS

SEQ ID NO: 2775 - protein, 12 aa, Artificial Sequence
  Synthetic
ATLGWLRGSFDY

SEQ ID NO: 2776 - protein, 112 aa, Artificial Sequence
  Synthetic
NFMLTQPHSVSESPGKTVTISCTCSSGSIASNYVQWYQQRPGSAPTTVIYEDNQRPSGVPDRFSGSIDSSSNSASLTISGLKTEDEADYYCQSYDSSKPDWVFGGGTKLTVL

SEQ ID NO: 2777 - protein, 11 aa, Artificial Sequence
  Synthetic
QSYDSSKPDWV

SEQ ID NO: 2778 - protein, 120 aa, Artificial Sequence
  Synthetic
QLQLQESGPGLVKPSETLSLTCTVSGGSISSSSYYWGWIRQPPGKGLECIGSIYYSGSTYYNPSLKSRVTISVDTSKNQFSLKLSSVTAADTAVYYCARLQWLRGYFDYWGQGTLVTVSS

SEQ ID NO: 2779 - protein, 12 aa, Artificial Sequence
  Synthetic
ARLQWLRGYFDY

SEQ ID NO: 2780 - protein, 111 aa, Artificial Sequence
  Synthetic
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDISNHWVFGGGTKLTVL

SEQ ID NO: 2781 - protein, 10 aa, Artificial Sequence
  Synthetic
QSYDISNHWV

SEQ ID NO: 2782 - protein, 125 aa, Artificial Sequence; identical to SEQ ID NO: 2646
  Synthetic

SEQ ID NO: 2783 - protein, 17 aa, Artificial Sequence
  Synthetic
AREVRSSWYGATHYFDY

SEQ ID NO: 2784 - protein, 111 aa, Artificial Sequence; identical to SEQ ID NO: 2664
  Synthetic

SEQ ID NO: 2785 - protein, 11 aa, Artificial Sequence
  Synthetic
CSYAGSSTFLV

SEQ ID NO: 2786 - protein, 124 aa, Artificial Sequence; identical to SEQ ID NO: 2702
  Synthetic

SEQ ID NO: 2787 - protein, 17 aa, Artificial Sequence
  Synthetic
AKGGMYYYGSGSYSFDY

SEQ ID NO: 2788 - protein, 110 aa, Artificial Sequence; identical to SEQ ID NO: 2716
  Synthetic

SEQ ID NO: 2789 - protein, 11 aa, Artificial Sequence
  Synthetic
AAWDDSLSGHV

SEQ ID NO: 2790 - protein, 125 aa, Artificial Sequence; identical to SEQ ID NO: 2646
  Synthetic

SEQ ID NO: 2791 - protein, 17 aa, Artificial Sequence
  Synthetic
AREVRSSWYGATHYFDY

SEQ ID NO: 2792 - protein, 111 aa, Artificial Sequence; identical to SEQ ID NO: 2664
  Synthetic

SEQ ID NO: 2793 - protein, 11 aa, Artificial Sequence
  Synthetic
CSYAGSSTFLV

SEQ ID NO: 2794 - protein, 124 aa, Artificial Sequence
  Synthetic
QVQLVQSGAEVKKPGSSVKVSCKASGGTFSSYAISWVRQAPGQGLEWMGGIIPIFGSRNYAQKFQGRVTITADESTSTAYMELSSLKSEDTAVYYCASSRFTPDHRYYYGMDVWGQGTTVTVSS

SEQ ID NO: 2795 - protein, 17 aa, Artificial Sequence
  Synthetic
ASSRFTPDHRYYYGMDV

SEQ ID NO: 2796 - protein, 110 aa, Artificial Sequence
  Synthetic
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVL

SEQ ID NO: 2797 - protein, 11 aa, Artificial Sequence
  Synthetic
AAWDDSLNGVV

SEQ ID NO: 2798 - protein, 124 aa, Artificial Sequence
  Synthetic
EVQLVESGGGLVQPGRSLRLSCVVSGFIFDDYAMHWVRQAPGKGLEWVAGISWNSDTKGYVDSVKGRFTISRDNAKKSLYLQMNSLRAEDTALYYCAKGGMYYYGSGSYSFDYWGQGTLVTVSS

SEQ ID NO: 2799 - protein, 17 aa, Artificial Sequence
  Synthetic
AKGGMYYYGSGSYSFDY

SEQ ID NO: 2800 - protein, 110 aa, Artificial Sequence
  Synthetic
QSVLTQPPSASGTPGQRVTISCSGSSSNIGSNSVFWYQQLPGTAPKLLIYRNNLRPSGVPDRFSGSKSGTSASLAISGLRSEDEADYYCAAWDDSLSGHVFGTGTKVTVL

SEQ ID NO: 2801 - protein, 11 aa, Artificial Sequence
  Synthetic
AAWDDSLSGHV

SEQ ID NO: 2802 - protein, 132 aa, Artificial Sequence
  Synthetic
QLQLQESGPGLVKPSETLSLTCTVSGGSISSSTYYWGWIRQPPGKGLEWIGSIYYSGSTYYNPSLNSRVTISVDTSKSRFSLKLSSVTAADTAVYYCARHLGRGHLGYCSSNSCWRYGMDVWGQGTTVTVSS

SEQ ID NO: 2803 - protein, 24 aa, Artificial Sequence
  Synthetic
ARHLGRGHLGYCSSNSCWRYGMDV

SEQ ID NO: 2804 - protein, 106 aa, Artificial Sequence
  Synthetic
SYVLTQPPSVSVSPGQTASITCSGDKLGDKFGCWYQQKPGQSPVLVIYQDIKRPSGIPERFSGSNSGNTATLTISGTQAMDEADYYCQAWDSNTVVFGGGTKLTVL

SEQ ID NO: 2805 - protein, 9 aa, Artificial Sequence
  Synthetic
QAWDSNTVV

SEQ ID NO: 2806 - protein, 121 aa, Artificial Sequence
  Synthetic
EVQLVESGGGLVQPGRSLRLSCAASGFTFDDYAMHWVRQAPGKGLEWVSGISWNSGSIDYADSVKGRFTISRDNAKNSLYLQMNSLRAEDTALYYCAKEDYYDSSGSFDYWGQGTLVTVSS

SEQ ID NO: 2807 - protein, 14 aa, Artificial Sequence
  Synthetic
AKEDYYDSSGSFDY

SEQ ID NO: 2808 - protein, 110 aa, Artificial Sequence
  Synthetic
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 2809 - protein, 10 aa, Artificial Sequence
  Synthetic
SSYTSSSTWV

SEQ ID NO: 2810 - protein, 124 aa, Artificial Sequence; identical to SEQ ID NO: 2702
  Synthetic

SEQ ID NO: 2811 - protein, 17 aa, Artificial Sequence
  Synthetic
AKGGMYYYGSGSYSFDY

SEQ ID NO: 2812 - protein, 110 aa, Artificial Sequence; identical to SEQ ID NO: 2716
  Synthetic

SEQ ID NO: 2813 - protein, 11 aa, Artificial Sequence
  Synthetic
AAWDDSLSGHV

SEQ ID NO: 2814 - protein, 122 aa, Artificial Sequence
  Synthetic
QVQLVQSGAEVKKPGSSVKVSCKASGGTFSSYASSWVRQAPGQGLEWMGGIIPILGTANYAQKFQGRVTITADESTSTAYMELSSLRSEDTAVYYCARAPPSGSTEYYFDYWGQGTLVTVSS

SEQ ID NO: 2815 - protein, 15 aa, Artificial Sequence
  Synthetic
ARAPPSGSTEYYFDY

SEQ ID NO: 2816 - protein, 111 aa, Artificial Sequence
  Synthetic
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQPWVFGGGTKLTVL

SEQ ID NO: 2817 - protein, 11 aa, Artificial Sequence
  Synthetic
LLYYGGAQPWV

SEQ ID NO: 2818 - protein, 125 aa, Artificial Sequence; identical to SEQ ID NO: 2646
  Synthetic

SEQ ID NO: 2819 - protein, 17 aa, Artificial Sequence
  Synthetic
AREVRSSWYGATHYFDY

SEQ ID NO: 2820 - protein, 111 aa, Artificial Sequence; identical to SEQ ID NO: 2664
  Synthetic

SEQ ID NO: 2821 - protein, 11 aa, Artificial Sequence
  Synthetic
CSYAGSSTFLV

SEQ ID NO: 2822 - protein, 131 aa, Artificial Sequence
  Synthetic
QVQLQQWGAGLLKPSETLSLTCAVYGGSFSGYYWNWIRQPPGKGLEWIGEINHSGSTNYNPSLKSRVTISVDTSKNQFSLKLSSVTAADTAVYYCARGNPIHPHDYCSGGSCNPPYYFDYWGQGTLVTVSS

SEQ ID NO: 2823 - protein, 25 aa, Artificial Sequence
  Synthetic
ARGNPIHPHDYCSGGSCNPPYYFDY

SEQ ID NO: 2824 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAISGLQAEDEADYYCQSYDSSLSGSVFGGGTKLTVL

SEQ ID NO: 2825 - protein, 11 aa, Artificial Sequence
  Synthetic
QSYDSSLSGSV

SEQ ID NO: 2826 - protein, 121 aa, Artificial Sequence
  Synthetic
EVQLVESGGGLVQPGRSLRLSCAASGFTFDDYAMHWVRQAPGKGLEWVSGISWNSGSIGYADSVKGRFTISRDNAKNSLYLQMNSLRTEDTALYYCAKDIGSGYGDYFDYWGQGTLVTVSS

SEQ ID NO: 2827 - protein, 14 aa, Artificial Sequence
  Synthetic
AKDIGSGYGDYFDY

SEQ ID NO: 2828 - protein, 108 aa, Artificial Sequence
  Synthetic
SYVLTQPPSVSVAPGKTARITCGGNNIGSKSVHWYQQKPGQAPVLVIYYDSDRPSGIPERFSGSNSGNTATLTISRVEAGDEADYYCQVWDSSRDHYVFGTGTKLSVL

SEQ ID NO: 2829 - protein, 11 aa, Artificial Sequence
  Synthetic
QVWDSSRDHYV

SEQ ID NO: 2830 - protein, 119 aa, Artificial Sequence; identical to SEQ ID NO: 2754
  Synthetic

SEQ ID NO: 2831 - protein, 12 aa, Artificial Sequence
  Synthetic
ARKRWLQGDFDY

SEQ ID NO: 2832 - protein, 111 aa, Artificial Sequence
  Synthetic
NFMLTQPHSVSESPGKTVTISCTRSSGSIASNYVQWYRQRPGSAPTTVIYEDNQRPSGVPDRFSGSIDSSSNSASLTISGLKTEDEADYYCQSYDSSNHGVFGGGTKLTVL

SEQ ID NO: 2833 - protein, 10 aa, Artificial Sequence
  Synthetic
QSYDSSNHGV

SEQ ID NO: 2834 - protein, 128 aa, Artificial Sequence
  Synthetic
QVQLVESGGGVVQPGRSLRLSCAASGFTFSSYGMHWVRQAPGKGLEWVAVIWSDGSNKYYGDSVKGRFTISRDNSKNTLYLQMNSLRAEDTALYYCAREGRYYYDSSGYLHRTPFDYWGQGTLVTVSS

SEQ ID NO: 2835 - protein, 21 aa, Artificial Sequence
  Synthetic
AREGRYYYDSSGYLHRTPFDY

SEQ ID NO: 2836 - protein, 108 aa, Artificial Sequence
  Synthetic
SYVLTQPPSVSVAPGKTASITCGGNNIGIKSVHWYQQKPGQAPILVIDYDSDRPSGIPERFSGSNSGNTATLTINRVEAGDEADYYCQVWDSSSDHWVFGGGTKLTVL

SEQ ID NO: 2837 - protein, 11 aa, Artificial Sequence
  Synthetic
QVWDSSSDHWV

SEQ ID NO: 2838 - protein, 120 aa, Artificial Sequence
  Synthetic
EVQLLESGGGLVQPGGSLRLSCAASGFTFSSYAMSWVRQAPGKGLEWVSTISGSGGSTYYADSVKGRFTISRDNSKNTLYLQMNSLRAEDTAVYYCAKQICGWYCGFDPWGQGTLVTVSS

SEQ ID NO: 2839 - protein, 13 aa, Artificial Sequence
  Synthetic
AKQICGWYCGFDP

SEQ ID NO: 2840 - protein, 109 aa, Artificial Sequence
  Synthetic
NFMLTQPHSVSESPGKTVTISCTRSSGSFASNYVQWYQQRPGSAPTTVIYEDNQRPSGVPDRFSGSIDSSSNSASLTISGLKTEDEADYYCQSYDSSIVFGGGTKLTVL

SEQ ID NO: 2841 - protein, 8 aa, Artificial Sequence
  Synthetic
QSYDSSIV

SEQ ID NO: 2842 - protein, 120 aa, Artificial Sequence
  Synthetic
EVQLVESGGGLIQPGGSLRLSCAASGLTVSSNYMSWVRQAPGKGLEWVSVIYSGGSTHYADSVKGRFTISRDNSKNTLYLQMNSLRAEDTAVYYCARDLGLYSGYGMDVWGQGTTVTVSS

SEQ ID NO: 2843 - protein, 14 aa, Artificial Sequence
  Synthetic
ARDLGLYSGYGMDV

SEQ ID NO: 2844 - protein, 112 aa, Artificial Sequence
  Synthetic
QSVLTQPPSASGTPGQRVTISCSGGSSNIGIDYVYWYQQLPGTAPKLLIYRNTQRPSGVPDRFSGSKSGTSASLAISGLRSEDEADYYCAAWDDSLSGGGWVFGGGTKLTVL

SEQ ID NO: 2845 - protein, 13 aa, Artificial Sequence
  Synthetic
AAWDDSLSGGGWV

SEQ ID NO: 2846 - protein, 124 aa, Artificial Sequence; identical to SEQ ID NO: 2702
  Synthetic

SEQ ID NO: 2847 - protein, 17 aa, Artificial Sequence
  Synthetic
AKGGMYYYGSGSYSFDY

SEQ ID NO: 2848 - protein, 110 aa, Artificial Sequence; identical to SEQ ID NO: 2716
  Synthetic

SEQ ID NO: 2849 - protein, 11 aa, Artificial Sequence
  Synthetic
AAWDDSLSGHV

SEQ ID NO: 2850 - protein, 123 aa, Artificial Sequence
  Synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDSSGWYPPRWYFDLWGRGTLVTVSS

SEQ ID NO: 2851 - protein, 16 aa, Artificial Sequence
  Synthetic
AKDSSGWYPPRWYFDL

SEQ ID NO: 2852 - protein, 110 aa, Artificial Sequence
  Synthetic
QSVLTQPPSASGTPGQRVTISCSGSSSNIGSNTVNWYQQLPGTAPKLLIYSNNQRSSGVPDRFSGSKSGTSASLAISGLQSEDEADYYCAAWDDSLHGPVFGGGTKLTVL

SEQ ID NO: 2853 - protein, 11 aa, Artificial Sequence
  Synthetic
AAWDDSLHGPV

SEQ ID NO: 2854 - protein, 124 aa, Artificial Sequence
  Synthetic
QVQLVESGGGVVQPGRSLRLSCAASGFTFSSYGMHWVRQAPGKGLEWVAVISYDGGIKYYPDSVKGRFTISRDNSKNTLYLQMNSLRAEDTAVYYCAKDPLSGIVGATAYFDYWGQGTLVTVSS

SEQ ID NO: 2855 - protein, 17 aa, Artificial Sequence
  Synthetic
AKDPLSGIVGATAYFDY

SEQ ID NO: 2856 - protein, 109 aa, Artificial Sequence
  Synthetic
SYVLTQPPSVSVAPGKTARITCGGNNIGSKSVHWYQQKPGQAPVLVVYDDSDRPSGIPERFSGSNSGNTATLTISRVEAGDEADYYCQVWDSSSDHHYVFGTGTKVTVL

SEQ ID NO: 2857 - protein, 12 aa, Artificial Sequence
  Synthetic
QVWDSSSDHHYV

SEQ ID NO: 2858 - protein, 118 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARAGWLRGPFDYWGQGTLVTVSS

SEQ ID NO: 2859 - protein, 12 aa, Artificial Sequence
  Synthetic
ARAGWLRGPFDY

SEQ ID NO: 2860 - protein, 109 aa, Artificial Sequence
  Synthetic
NFMLTQPHSVSESPGKTVTISCTRSSGSIASNYVQWCQQRPGSSPTTVIYEDNQRPSGVPDRFSGSIDSSSNSASLTISGLKTEDEADYYCQSYDSLVVFGGGTKLTVL

SEQ ID NO: 2861 - protein, 8 aa, Artificial Sequence
  Synthetic
QSYDSLVV

SEQ ID NO: 2862 - protein, 125 aa, Artificial Sequence
  Synthetic
EVQLVESGGGLVQPGRSLRLSCAAFGFNLDDYAMQWVRQAPGKGLEWVSGISWNSGSIGYADSVKGRFTISRDNAKNSLYLQMNSLRAEDTALYYCAKDRGKKQWLVQVNWFDPWGQGTLVTVSS

SEQ ID NO: 2863 - protein, 18 aa, Artificial Sequence
  Synthetic
AKDRGKKQWLVQVNWFDP

SEQ ID NO: 2864 - protein, 110 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL

SEQ ID NO: 2865 - protein, 11 aa, Artificial Sequence
  Synthetic
GTWDSSLSAGV

SEQ ID NO: 2866 - protein, 122 aa, Artificial Sequence
  Synthetic
QVQLVQSGAEVKKPGSSVKVSCKASRGTFSNYALSWVRQAPGQGLEWMGGIVPIFGTAAYAQKFQGRVTIIADESTNTTYMELSSLRSEDTAVYYCARSGGIVGYGDYFLLWGQGTLVTVSS

SEQ ID NO: 2867 - protein, 15 aa, Artificial Sequence
  Synthetic
ARSGGIVGYGDYFLL

SEQ ID NO: 2868 - protein, 111 aa, Artificial Sequence
  Synthetic
SYVLTQPPSVSVAPGKTARITCGGNNIGSKSVHWYQQRPGQAPVLVVYDDSDRPSGIPERFSGSNSGNTATLTISRVEAGDEADYYCQVWDGSSVHSDHYVFGTGTKVTVL

SEQ ID NO: 2869 - protein, 14 aa, Artificial Sequence
  Synthetic
QVWDGSSVHSDHYV

SEQ ID NO: 2870 - protein, 129 aa, Artificial Sequence
  Synthetic
EVQLVESGGGLVQPGGSLRLSCAASGFTFSSYDMNWVRQAPGKGLEWVSYISSSSSTIYYADSVKGRFTISRDNAKNSLYLQMNSLRDEDTAVYYCATNAITFGGVIALGGYYYGMDVWGQGTTVTVSS

SEQ ID NO: 2871 - protein, 22 aa, Artificial Sequence
  Synthetic
ATNAITFGGVIALGGYYYGMDV

SEQ ID NO: 2872 - protein, 112 aa, Artificial Sequence
  Synthetic
DIVMTQSPDSLAVSGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 2873 - protein, 9 aa, Artificial Sequence
  Synthetic
QQYYSTPLT

SEQ ID NO: 2874 - protein, 127 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKMNGVYCSGGNCYSGYFDYWGQGTLVTVSS

SEQ ID NO: 2875 - protein, 20 aa, Artificial Sequence
  Synthetic
AKMNGVYCSGGNCYSGYFDY

SEQ ID NO: 2876 - protein, 106 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYGTFGQGTKVEIK

SEQ ID NO: 2877 - protein, 8 aa, Artificial Sequence
  Synthetic
QQYNSYGT

SEQ ID NO: 2878 - protein, 120 aa, Artificial Sequence
  Synthetic
EVQLVESGGGLIQPGGSLRLSCAASGFTVSSNYMSWVRQAPGKGLEWVSVIYPGGSTYYADSVKGRFTISRDNSKNTLYLQMNSLRAEDTAVYYCARDFYYDSSGFHDYWGQGTLVTVSS

SEQ ID NO: 2879 - protein, 14 aa, Artificial Sequence
  Synthetic
ARDFYYDSSGFHDY

SEQ ID NO: 2880 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPRTFGQGTKVEIK

SEQ ID NO: 2881 - protein, 9 aa, Artificial Sequence
  Synthetic
QQYDNLPRT

SEQ ID NO: 2882 - protein, 128 aa, Artificial Sequence
  Synthetic
EVQLVESGGVVVQPGGSLRLSCAASGFTFDDYTMHWVRQAPGKGLEWVSLISWEDNSTYYADSVKGRFTISRDNSKNSLYLQMNSLTTEDTALYYCAKDIGIGQYSGYFYYHYGMDVWGPGTTVTVSS

SEQ ID NO: 2883 - protein, 21 aa, Artificial Sequence
  Synthetic
AKDIGIGQYSGYFYYHYGMDV

SEQ ID NO: 2884 - protein, 107 aa, Artificial Sequence
  Synthetic
DIQLTQSPSFLSASVGDRVTITCRASQGISSYLAWYQKKPGKVPKLLIYAASTLQSGVPSRFSGSGSGTEFTLTISSLQPEDFATYYCQQLNSYPITFGQGTRLEIK

SEQ ID NO: 2885 - protein, 9 aa, Artificial Sequence
  Synthetic
QQLNSYPIT

SEQ ID NO: 2886 - protein, 128 aa, Artificial Sequence
  Synthetic
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTSLLYNWNDGDLYYYGMDVWGQGTTVTVSS

SEQ ID NO: 2887 - protein, 19 aa, Artificial Sequence
  Synthetic
TSLLYNWNDGDLYYYGMDV

SEQ ID NO: 2888 - protein, 108 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNWPPLTFGGGTKVEIK

SEQ ID NO: 2889 - protein, 10 aa, Artificial Sequence
  Synthetic
QQYNNWPPLT

SEQ ID NO: 2890 - protein, 122 aa, Artificial Sequence
  Synthetic
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCAKAYYYGSGSYWFDLWGRGTLVTVSS

SEQ ID NO: 2891 - protein, 15 aa, Artificial Sequence
  Synthetic
AKAYYYGSGSYWFDL

SEQ ID NO: 2892 - protein, 113 aa, Artificial Sequence
  Synthetic
DIVMTQSPDSLAVSLGERATINCKSSQSVLYSSNNENYLAWYQQKPGQPPKLLIYWASARESGVPDRFSGSGSGTDFTLTISSLQAEDVAVYYCQQYYSTPLTFGGGTKVEIK

SEQ ID NO: 2893 - protein, 9 aa, Artificial Sequence
  Synthetic
QQYYSTPLT

SEQ ID NO: 2894 - protein, 120 aa, Artificial Sequence
  Synthetic
EVQLVESGGGLMQPGGSLRLSCAASGLIVSSNYMTWVRQAPGKGLEWVSVIYSGGSTFYADSVKGRFTISRDNSKNTLYLQMNSLRAEDTAVYYCAREGGFSYGSAFDIWGQGTMVTVSS

SEQ ID NO: 2895 - protein, 14 aa, Artificial Sequence
  Synthetic
AREGGFSYGSAFDI

SEQ ID NO: 2896 - protein, 108 aa, Artificial Sequence; identical to SEQ ID NO: 544
  Synthetic

SEQ ID NO: 2897 - protein, 10 aa, Artificial Sequence
  Synthetic
QQYDNLPSYT

SEQ ID NO: 2898 - protein, 115 aa, Artificial Sequence
  Synthetic
EVQLVESGGGLIQPGGSLRLSCAASGFIVSSNYMNWVRQTPGKGLEWVSVIYSGGSTFYADSVKGRFTISRDNSKNTLFLQMNSLRAEDTAVYYCAREAHGFDIWGQGTMVTVSS

SEQ ID NO: 2899 - protein, 9 aa, Artificial Sequence
  Synthetic
AREAHGFDI

SEQ ID NO: 2900 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQLLNSDPPTFGQGTKVEIK

SEQ ID NO: 2901 - protein, 9 aa, Artificial Sequence
  Synthetic
QLLNSDPPT

SEQ ID NO: 2902 - protein, 119 aa, Artificial Sequence
  Synthetic
EVQLVESGGGLIQPGGSLRLSCAASGFTVSSNYMSWVRQAPGKGLEWVSVIYGVGTTYYADSVKGRFTISRDNSNNTLNLQMSSLRAEDTAVYYCARGYGVWSGYVDYWGQGTLVTVSS

SEQ ID NO: 2903 - protein, 13 aa, Artificial Sequence
  Synthetic
ARGYGVWSGYVDY

SEQ ID NO: 2904 - protein, 108 aa, Artificial Sequence
  Synthetic
EIVMTQSPATLSVSPGERATLSCRASQSVSSYLAWYQQKPGQAPRLLIYNASTRATGIPARFSGSGSGTEFTLTISSLQSEDFAVYYCQQYHNWPLYTFGQGTKLEIK

SEQ ID NO: 2905 - protein, 10 aa, Artificial Sequence
  Synthetic
QQYHNWPLYT

SEQ ID NO: 2906 - protein, 121 aa, Artificial Sequence
  Synthetic
QVQLVQSGAEVKKPGSSVKVSCKASGGTLSSYGINWVRQAPGQGLEWLGGIILIFGTTNYAQKFQGRVTITADESTSTAYMELSSLRSEDTAVYYCARDHIISPLYGMDVWGQGTTVTVSS

SEQ ID NO: 2907 - protein, 14 aa, Artificial Sequence
  Synthetic
ARDHIISPLYGMDV

SEQ ID NO: 2908 - protein, 108 aa, Artificial Sequence
  Synthetic
DIQMTQSPSSLSASIGDRVTITCRASQSISTYLNWYQQKPGKAPKLLIYAASSLESGVPSRFSGSGSGTDFTLTISSLQPEDFATYYCQQTYSTPPLTFGGGTKVEIK

SEQ ID NO: 2909 - protein, 10 aa, Artificial Sequence
  Synthetic
QQTYSTPPLT

SEQ ID NO: 2910 - protein, 127 aa, Artificial Sequence
  Synthetic
QVQLVESGGGVVQPGRSLRLSCTVSGFTFSRYGMHWVRQAPGKGLEWVAVISYDGSNKYFADSVKGRFTISRDNSKDTVYLQMNSLRAEDTAVYYCAKQRGTYCSGGSCYSGEFDYWGQGNLVTVSS

SEQ ID NO: 2911 - protein, 20 aa, Artificial Sequence
  Synthetic
AKQRGTYCSGGSCYSGEFDY

SEQ ID NO: 2912 - protein, 108 aa, Artificial Sequence
  Synthetic
DIQMTQSPSSLSASVGDRVTITCQASQDISNSLNWYQQKPGKAPKLLIYDASNLETGVPSRFSGSGSGTDFTFTISSLQPEDIATYYCQQYDNLPPYTFGQGTKLEIK

SEQ ID NO: 2913 - protein, 10 aa, Artificial Sequence
  Synthetic
QQYDNLPPYT

SEQ ID NO: 2914 - protein, 130 aa, Artificial Sequence
  Synthetic
QLQLQESGPGLVKPSETLSLTCTVSGGSISSSSYYWGWIRQPPGKGLEWVGTIYYTGSTYYNPSLKTRVTISVDTSKNQFSLKLTSVTAADTAVYYCARHRCDFRCGWLQFMRIGAFDIWGQGTMVTVSS

SEQ ID NO: 2915 - protein, 22 aa, Artificial Sequence
  Synthetic
ARHRCDFRCGWLQFMRIGAFDI

SEQ ID NO: 2916 - protein, 108 aa, Artificial Sequence
  Synthetic
DIQMTQSPSSLSASVGDRVTITCQASQDITNYLNWYQQKPGKAPKLLIYDASNLETGVPSRFSGSGSGTDFTFTISSLQPEDIATYFCQQYDSLPLFTFGPGTKVDIK

SEQ ID NO: 2917 - protein, 10 aa, Artificial Sequence
  Synthetic
QQYDSLPLFT

SEQ ID NO: 2918 - protein, 127 aa, Artificial Sequence
  Synthetic
QVQLVQSGAEVKKPGASVKVSCKASGYTFTSYGISWVRQAPGQGLEWMGWISTYNGNTNYAQQLQGRVTMTTDTSTSTAYMELRSLRSDDTAVYYCARKAVPANLYDFWSDHYFDYWGQGTLVTVSS

SEQ ID NO: 2919 - protein, 20 aa, Artificial Sequence
  Synthetic
ARKAVPANLYDFWSDHYFDY

SEQ ID NO: 2920 - protein, 107 aa, Artificial Sequence
  Synthetic
EIVMTQSPATLSVSPGERATLSCRASQSISSNLAWYQQKPGQAPRLLIYGASTRATGIPARFSGSGSGTEFTLTISSLQSEDFAVYYCQQYNNWPWTFGQGTKVEIK

SEQ ID NO: 2921 - protein, 9 aa, Artificial Sequence
  Synthetic
QQYNNWPWT

SEQ ID NO: 2922 - protein, 123 aa, Artificial Sequence
  Synthetic
QVQLQQWGAGLLKPSETLSLTCAVYGGSFSGYYWSWIRQPPGKGLEWIGDINHSGSTNYNPSLKSRVTISVDTSKNQFSLKLSSVTAADTAVYYCARPGYSSSWYVGHWFDPWGQGTLVTVSS

SEQ ID NO: 2923 - protein, 17 aa, Artificial Sequence
  Synthetic
ARPGYSSSWYVGHWFDP

SEQ ID NO: 2924 - protein, 107 aa, Artificial Sequence
  Synthetic
DIQMTQSPSSLSASVGDRVTITCRASQGISNSLAWYQQKPGKAPKLLLYTASRLESGVPSRFSGSGSGTDYTLTISSLQPEDFATYYCQQYYSTPLTFGQGTKVEIK

SEQ ID NO: 2925 - protein, 9 aa, Artificial Sequence
  Synthetic
QQYYSTPLT

SEQ ID NO: 2926 - protein, 123 aa, Artificial Sequence
  Synthetic
EVQLVESGGGLVEPGGSLRLSCAASGFTLSSYNMNWVRQAPGKGLEWVSYISSSSSTIYYADSVKGRFTISRDNAKNSLYLQMNSLRDEDTAVYYCTRGTGAKSYYYYGLDVWGQGTTVTVSS

SEQ ID NO: 2927 - protein, 16 aa, Artificial Sequence
  Synthetic
TRGTGAKSYYYYGLDV

SEQ ID NO: 2928 - protein, 107 aa, Artificial Sequence
  Synthetic
DIQMTQSPSSLSASVGDRVTITCRASQSISSYLNWYQQKPGKAPKLLIYTASSLQSGVPSRFSGSGSGTDFTLTISSLQPEDFATYYCQQSYSTPSAFGQGTRLEIK

SEQ ID NO: 2929 - protein, 9 aa, Artificial Sequence
  Synthetic
QQSYSTPSA

SEQ ID NO: 2930 - protein, 123 aa, Artificial Sequence
  Synthetic
QVQLQESGPGLVKPSETLSLTCNVSGGSISSYYWSWIRQPAGKGLEWIGRIYTSGSTNYNPSLKSRVTMSVDTSKNQFSLKLTSVTAADTAVYYCARDSRVPGAHSVLGMDVWGQGTTVTVSS

SEQ ID NO: 2931 - protein, 17 aa, Artificial Sequence
  Synthetic
ARDSRVPGAHSVLGMDV

SEQ ID NO: 2932 - protein, 107 aa, Artificial Sequence
  Synthetic
DIQMTQSPSSLSASVGDRVTITCQASQDIGNYLNWYQHKPGKAPKLLIYDASNLETGVPSRFSGSGSGTDFTFTISSLQPEDIATYYCQQYDDVLCTFGQGTNLEIK

SEQ ID NO: 2933 - protein, 9 aa, Artificial Sequence
  Synthetic
QQYDDVLCT

SEQ ID NO: 2934 - protein, 115 aa, Artificial Sequence
  Synthetic
QVQLQQWGAGLLKPSETLSLTCAVYGGSFSGYFWGWIRQPPGKGLEWIGEITHSGSTYYDPSLKSRVTISVDTSKNQFSLKLSSVTAADTAVYYCARGKGLFESWGQGTLVTVSS

SEQ ID NO: 2935 - protein, 9 aa, Artificial Sequence
  Synthetic
ARGKGLFES

SEQ ID NO: 2936 - protein, 108 aa, Artificial Sequence
  Synthetic
DIQMTQSPSSLSASVGDRVTITCRASQGISNSLAWYQQKPGKAPKLLLYAASTLESGVPSRFSGSGSGTDYTLTISSLQPEDFATYYCQQYYSAPPRTFGQGTKVEIK

SEQ ID NO: 2937 - protein, 10 aa, Artificial Sequence
  Synthetic
QQYYSAPPRT

SEQ ID NO: 2938 - protein, 123 aa, Artificial Sequence
  Synthetic
QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPYCSGGSCYDAFDIWGQGTMVTVSS

SEQ ID NO: 2939 - protein, 16 aa, Artificial Sequence
  Synthetic
AAPYCSGGSCYDAFDI

SEQ ID NO: 2940 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2941 - protein, 9 aa, Artificial Sequence
  Synthetic
QQYGSSPWT

SEQ ID NO: 2942 - protein, 121 aa, Artificial Sequence
  Synthetic
QVQLVESGGGVVQPGRSLRLSCAASGFTFSTYGMHWVRQAPGKGLEWVAVISYDGSNKYYADSVKGRFTISRDNSKNTLYLQMNSLRAEDTAVYYCAKAGGYSYAYYSDYWGQGTLVTVSS

SEQ ID NO: 2943 - protein, 14 aa, Artificial Sequence
  Synthetic
AKAGGYSYAYYSDY

SEQ ID NO: 2944 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 2945 - protein, 9 aa, Artificial Sequence
  Synthetic
QQYDNLPLT

SEQ ID NO: 2946 - protein, 127 aa, Artificial Sequence
  Synthetic
QVQLVESGGGVVQPGRSLRLSCAASGFTFSSYGMHWVRQAPGKGLEWVAVISFDGSNKYYADSLKGRFTISRDNSKNTLYLQMNSLRAEDTAVYYCAKTVGLYCSGGSCYSGVFDYWGQGTLVTVSS

SEQ ID NO: 2947 - protein, 20 aa, Artificial Sequence
  Synthetic
AKTVGLYCSGGSCYSGVFDY

SEQ ID NO: 2948 - protein, 107 aa, Artificial Sequence
  Synthetic
DIQMTQSPSSLSASVGDRVTITCQASQDISNYLNWYQQKPGKAPNLLIYDASNLETGVPSRFSGSGSGTDFTFTISSLQPEDFATYYCQQYDNLPFTFGPGTKVDIK

SEQ ID NO: 2949 - protein, 9 aa, Artificial Sequence
  Synthetic
QQYDNLPFT

SEQ ID NO: 2950 - protein, 123 aa, Artificial Sequence
  Synthetic
EVQLVESGGGLIQPGGSLRLSCAASGVTVSSNYMSWVRQAPGKGLEWVSVIYSGGSTYYADSVKGRFTISRDNSKNTLYLQMNSLRAEDTAVYYCARDRASSGYQGDDPFDIWGQGTMVTVSS

SEQ ID NO: 2951 - protein, 17 aa, Artificial Sequence
  Synthetic
ARDRASSGYQGDDPFDI

SEQ ID NO: 2952 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPPTFGGGTKVEIK

SEQ ID NO: 2953 - protein, 9 aa, Artificial Sequence
  Synthetic
QQYDNLPPT

SEQ ID NO: 2954 - protein, 120 aa, Artificial Sequence
  Synthetic
EVQLVESGGGLIQPGGSLRLSCAASGFTVSSNYMSWVRQAPGKGLEWVSLIYSGGSTFYADSVKGRFTISRDNSKNTLYLQMNSLRAEDTAVYYCARGGDSGYDYPWAYWGQGTLVTVSS

SEQ ID NO: 2955 - protein, 14 aa, Artificial Sequence
  Synthetic
ARGGDSGYDYPWAY

SEQ ID NO: 2956 - protein, 107 aa, Artificial Sequence; identical to SEQ ID NO: 118
  Synthetic

SEQ ID NO: 2957 - protein, 9 aa, Artificial Sequence
  Synthetic
QQYDNLPIT

SEQ ID NO: 2958 - protein, 133 aa, Artificial Sequence
  Synthetic
EVQLVESGGGLVKPGGSLRLSCAASGFTFSNYSINWVRQAPGKGLEWVSSISSGSSYIDYADSVKGRFTVSRDNAKNSLYLRMSSLRAEDTAVYYCARDIGLGYSSGWYDPGEYYYYYGMDVWGQGTTVTVSS

SEQ ID NO: 2959 - protein, 26 aa, Artificial Sequence
  Synthetic
ARDIGLGYSSGWYDPGEYYYYYGMDV

SEQ ID NO: 2960 - protein, 107 aa, Artificial Sequence
  Synthetic
DIQMTQSPSSVSASVGDRVTITCRASQGISSWLAWYQQKPGKAPKLLIYAASSLQSGVPSRFSGSGSGTDFTLTISSLQPEDSAIYYCQQANSFPRTFGQGTKVEIK

SEQ ID NO: 2961 - protein, 9 aa, Artificial Sequence
  Synthetic
QQANSFPRT

SEQ ID NO: 2962 - protein, 120 aa, Artificial Sequence
  Synthetic
EVQLVESGGGLIKPGGSLRLSCAASGLTVSSNYMSWVRQAPGKGLEWVSVIYPGGSTFYADSVKARFTISRDNSKNTLYLQMNSLRAEDTAVYYCARDFYYDSSGFHDYWGQGTLVTVSS

SEQ ID NO: 2963 - protein, 14 aa, Artificial Sequence
  Synthetic
ARDFYYDSSGFHDY

SEQ ID NO: 2964 - protein, 107 aa, Artificial Sequence
  Synthetic
DIQMTQSPSSLSASVGDRVTITCQASQDISKYLNWYQQKPGKAPKLLIYDASNLETGVPSRFSGSGSGTDFTFTISSLQPEDIATYYCQQYDNLPRTFGQGTKVEIK

SEQ ID NO: 2965 - protein, 9 aa, Artificial Sequence
  Synthetic
QQYDNLPRT

SEQ ID NO: 2966 - protein, 125 aa, Artificial Sequence
  Synthetic
QVQLVQSGAEVKKPGASVKVSCKASGYTFTGYYMQWVRQAPGQGLEWMGWINPNSGGTNYAQKFQGRVTMTRDTSISTAYMELSRLRSDDTAIYYCAKDWGCSGVWCNPEYFDYWGQGTLVTVSS

SEQ ID NO: 2967 - protein, 18 aa, Artificial Sequence
  Synthetic
AKDWGCSGVWCNPEYFDY

SEQ ID NO: 2968 - protein, 106 aa, Artificial Sequence
  Synthetic
DIQMTQSPSTLSASVGDRVTITCRASQSISSWLAWYQQKPGKAPKLLIYKASSLETGVPSRFSGSGSGTEFTLTISSLQPDDFATYYCQQYNTLVGFGQGTKVEIK

SEQ ID NO: 2969 - protein, 8 aa, Artificial Sequence
  Synthetic
QQYNTLVG

SEQ ID NO: 2970 - protein, 118 aa, Artificial Sequence
  Synthetic
EVQLVESGGGLIQPGGSLRLSCAASGLTVTSNYMNWVRQAPGKGLEWVSVVYSGGSTFYADSVKGRFTISRDNSKNTLYLQMNSLRAEDTAVYYCARDLEVAGGMDVWGQGTPVTVSS

SEQ ID NO: 2971 - protein, 12 aa, Artificial Sequence
  Synthetic
ARDLEVAGGMDV

SEQ ID NO: 2972 - protein, 107 aa, Artificial Sequence
  Synthetic
DIQLTQSPSFLSASVGDRVTITCRASQGISSYLAWYQQKPGKAPKVLIYAASTLQRGVPSRFSGSGSGTDFTLTISSLQPEDFATYYCQQLNSYPLTFGGGTKVEIK

SEQ ID NO: 2973 - protein, 9 aa, Artificial Sequence
  Synthetic
QQLNSYPLT

SEQ ID NO: 2974 - protein, 125 aa, Artificial Sequence
  Synthetic
QVQLVQSGAEVKKPGASVKVSCKASGYTFTGYYMHWVRQAPGQGLEWMGWINPDSGGTKYAQKFQGRVTMTREMSISTAYMELSRLRSDDTAVYYCAKDWGCSGDYCSPEYFDYWGQGTLVTVSS

SEQ ID NO: 2975 - protein, 18 aa, Artificial Sequence
  Synthetic
AKDWGCSGDYCSPEYFDY

SEQ ID NO: 2976 - protein, 106 aa, Artificial Sequence; identical to SEQ ID NO: 2968
  Synthetic

SEQ ID NO: 2977 - protein, 8 aa, Artificial Sequence
  Synthetic
QQYNTLVG

SEQ ID NO: 2978 - protein, 123 aa, Artificial Sequence; identical to SEQ ID NO: 2938
  Synthetic

SEQ ID NO: 2979 - protein, 16 aa, Artificial Sequence
  Synthetic
AAPYCSGGSCYDAFDI

SEQ ID NO: 2980 - protein, 108 aa, Artificial Sequence; identical to SEQ ID NO: 2940
  Synthetic

SEQ ID NO: 2981 - protein, 9 aa, Artificial Sequence
  Synthetic
QQYGSSPWT

SEQ ID NO: 2982 - protein, 127 aa, Artificial Sequence
  Synthetic
QVQLVESGGGVVQPGRSLRLSCAASGFTFSSYGMHWVRQAPGKGLEWVAVISYDGSDKYYADSVKGRITISRDNSKNTLYLQMNSLRAEDTAVYYCAKMNGVYCSGGNCYSGYFDYWGQGTLVTVSS

SEQ ID NO: 2983 - protein, 20 aa, Artificial Sequence
  Synthetic
AKMNGVYCSGGNCYSGYFDY

SEQ ID NO: 2984 - protein, 106 aa, Artificial Sequence
  Synthetic
DIQMTQSPSTLSASVGDRVTITCRASQSISSWLAWYQHKPGKAPKLLIYKASSLESGVPSRFSGSGSGTEFTLTISSLQPDDFATYYCQQYNSYGTFGQGTKVEIK

SEQ ID NO: 2985 - protein, 8 aa, Artificial Sequence
  Synthetic
QQYNSYGT

SEQ ID NO: 2986 - protein, 127 aa, Artificial Sequence; identical to SEQ ID NO: 2946
  Synthetic

SEQ ID NO: 2987 - protein, 20 aa, Artificial Sequence
  Synthetic
AKTVGLYCSGGSCYSGVFDY

SEQ ID NO: 2988 - protein, 107 aa, Artificial Sequence; identical to SEQ ID NO: 2948
  Synthetic

SEQ ID NO: 2989 - protein, 9 aa, Artificial Sequence
  Synthetic
QQYDNLPFT

SEQ ID NO: 2990 - protein, 125 aa, Artificial Sequence
  Synthetic
QVQLVQSGAEVKKPGSSVKVSCKASGGTFSSYGISWVRQAPGQGLEWMGGIIPIFGTAKYAQKFQGRVTITADETTSTAYMELSSLRAEDTAVYYCARSRPITMIVVATELLDYWGQGTLVTVSS

SEQ ID NO: 2991 - protein, 18 aa, Artificial Sequence
  Synthetic
ARSRPITMIVVATELLDY

SEQ ID NO: 2992 - protein, 113 aa, Artificial Sequence
  Synthetic
DIVMTQSPDSLAVSLGERATINCKSSQSVLYSSNNKNYLAWYLQKPGQPPKLLIYWASTRESGVPDRFSGSGSGTDFTLTISSLQAEDVAVYYCQQYYSTPLTFGQGTKLEIK

SEQ ID NO: 2993 - protein, 9 aa, Artificial Sequence
  Synthetic
QQYYSTPLT

SEQ ID NO: 2994 - protein, 125 aa, Artificial Sequence
  Synthetic
QVQLVQSGAEVKKPGASVKVSCKASGYTFTGYYIHWVRQAPGQGLEWMGWLNPNSGGTNYAQKFQGRVTMTRDTSISTAYMELSRLRSDDTAVYYCAKDWGCSGGYCYPEYFDYWGQGTLVTVSS

SEQ ID NO: 2995 - protein, 18 aa, Artificial Sequence
  Synthetic
AKDWGCSGGYCYPEYFDY

SEQ ID NO: 2996 - protein, 106 aa, Artificial Sequence
  Synthetic
DIQMTQSPVTLSASVGDRVTITCRASQSISSWLAWYQQKPGKAPKLLIYKASSLESGVPSRFSGSGSGTEFALTISSLQPDDFATYYCQQYNTLVGFGQGTKVEIK

SEQ ID NO: 2997 - protein, 8 aa, Artificial Sequence
  Synthetic
QQYNTLVG

SEQ ID NO: 2998 - protein, 122 aa, Artificial Sequence
  Synthetic
EVQLVQSGAEVKKPGESLKISCKGSGYSFTSYWIDWVRQMPGKGLEWMGIIYPGDSDTRYSPSFQGQVTSADKSISTAYLQWSSLKASDTAMYYCARQRYFGSGSYLSLDYWGQGTLVTVSS

SEQ ID NO: 2999 - protein, 16 aa, Artificial Sequence
  Synthetic
ARQRYFGSGSYLSLDY

SEQ ID NO: 3000 - protein, 107 aa, Artificial Sequence
  Synthetic
DIQMTQSPSSLSASVGDRVTITCRASQGISNSLAWYQQKPGKAPKLLLYAASRLESGVPSRFSGSGSGTDYTLTISSLQPEDFATYYCQQYYSTPYTFGQGTKLEIK

SEQ ID NO: 3001 - protein, 9 aa, Artificial Sequence
  Synthetic
QQYYSTPYT

SEQ ID NO: 3002 - protein, 123 aa, Artificial Sequence; identical to SEQ ID NO: 2938
  Synthetic

SEQ ID NO: 3003 - protein, 16 aa, Artificial Sequence
  Synthetic
AAPYCSGGSCYDAFDI

SEQ ID NO: 3004 - protein, 108 aa, Artificial Sequence; identical to SEQ ID NO: 2940
  Synthetic

SEQ ID NO: 3005 - protein, 9 aa, Artificial Sequence
  Synthetic
QQYGSSPWT

SEQ ID NO: 3006 - protein, 122 aa, Artificial Sequence
  Synthetic
QVQLVQSGAEVKKPGSSVKVSCKASGDTFSSYAINWVRQAPGQGLEWLGGIMPIFPTANYAQKFQGRVTITADESTSTAYMELSSLRSEDTAVYYCARDPPSGAPPYGMDVWGQGTTVTVSS

SEQ ID NO: 3007 - protein, 15 aa, Artificial Sequence
  Synthetic
ARDPPSGAPPYGMDV

SEQ ID NO: 3008 - protein, 109 aa, Artificial Sequence
  Synthetic
EIVLTQSPATLSLSPGERATLSCRASQSVSSYLAWYQQKPGQAPRLLIYAASNRATGIPARFSGSGSGTDFTLTISSLEPEDFAFYYCQQRSNWPPTWTFGQGTKVEIK

SEQ ID NO: 3009 - protein, 11 aa, Artificial Sequence
  Synthetic
QQRSNWPPTWT

SEQ ID NO: 3010 - protein, 123 aa, Artificial Sequence
  Synthetic
QVQLVQSGAEVKKPGASVKVSCKASGYTFSSQYMHWVRQAPGQGLEWMGIINPSAGSTTYARKFQGRVTMTGDTSTSTVYMELSSLRSEDTAVYYCARDWNFIPTGSHWFDSWGQGTLVTVSS

SEQ ID NO: 3011 - protein, 16 aa, Artificial Sequence
  Synthetic
ARDWNFIPTGSHWFDS

SEQ ID NO: 3012 - protein, 113 aa, Artificial Sequence
  Synthetic
DIVMTQSPDSLAVSLGERATINCKSSQSILYSSNNKNYLAWYQQKPGQPPKLLIYWASTRESGVPDRFSGSGSGTDFTLTISSLQAEDVAVYYCQQYYTTPLTFGGGTKVEIK

SEQ ID NO: 3013 - protein, 9 aa, Artificial Sequence
  Synthetic
QQYYTTPLT

SEQ ID NO: 3014 - protein, 123 aa, Artificial Sequence
  Synthetic
EVQLVESGGGLVQPGGSLRLSCAASGFTFSTYSMNWVRQAPGKGLEWVSYISSSSSTIYYADSVKGRFTISRDNAKNSLYLQMNSLRDEDTAVYYCARHYGDYSYYYYGMDVWGQGTTVTVSS

SEQ ID NO: 3015 - DNA, 16 bp, Artificial Sequence
  Synthetic
arhygdysyyyygmdv

SEQ ID NO: 3016 - protein, 107 aa, Artificial Sequence
  Synthetic
DIQMTQSPSSLSASVGDRVTITCRASQSISSYVNWYQQKPGKAPKLLIYAAISLQSGVPSRFSGSESGSVFTLTISSLQPEDFATYYCQQSYSTPPTFGGGTKVEIK

SEQ ID NO: 3017 - protein, 9 aa, Artificial Sequence
  Synthetic
QQSYSTPPT

SEQ ID NO: 3018 - protein, 120 aa, Artificial Sequence
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDYGNYVTWFDPWGQGTLVTVSS

SEQ ID NO: 3019 - protein, 13 aa, Artificial Sequence
  Synthetic
ARDYGNYVTWFDP

SEQ ID NO: 3020 - protein, 108 aa, Artificial Sequence; identical to SEQ ID NO: 142
  Synthetic

SEQ ID NO: 3021 - protein, 10 aa, Artificial Sequence
  Synthetic
QQSYSTPPWT

SEQ ID NO: 3022 - protein, 117 aa, Artificial Sequence
  Synthetic
QLQLQESGPGLVKPSETLSLTCTVSGGSISSSSYYWGWIRQPPGKGLEWIGTIYYSGSTYYNPSLKSRVTISVDTSKNQFSLKVSSVTAADTAVYYCAREMGVLDYWGQGTLVTVSS

SEQ ID NO: 3023 - protein, 9 aa, Artificial Sequence
  Synthetic
AREMGVLDY

SEQ ID NO: 3024 - protein, 108 aa, Artificial Sequence
  Synthetic
DIQMTQSPSSLSASVGDRVTITCRASQGISNSLAWYQQKPGKAPKLLLYAASTLESGVPSRFSGSGSGTDYTLTISSLQPEDFATYYCQQYYSTPPRTFGQGTKVEIK

SEQ ID NO: 3025 - protein, 10 aa, Artificial Sequence
  Synthetic
QQYYSTPPRT

SEQ ID NO: 3026 - protein, 122 aa, Artificial Sequence
  Synthetic
EVQLVESGGGLVQPGGSLRLSCAASGFTFRNYDMHWVRQTTGKGLEWVSVIGTAGDTYYPGSVKGRFTISRENAKNSLYLQMNSLRAGDTAVYYCVRVSYDSSGFFQIFDYWGQGTLVTVSS

SEQ ID NO: 3027 - protein, 16 aa, Artificial Sequence
  Synthetic
VRVSYDSSGFFQIFDY

SEQ ID NO: 3028 - protein, 108 aa, Artificial Sequence
  Synthetic
DIQMTQSPSSLSASVGDRVTITCRASQTISRYLNWYQQKPGKAPKLLIYAASSLQSGVPSRFSGSGSGTDFTLTISSLQPEDFATYYCHQTYSTPGLTFGGGTKVEIK

SEQ ID NO: 3029 - protein, 10 aa, Artificial Sequence
  Synthetic
HQTYSTPGLT

SEQ ID NO: 3030 - protein, 126 aa, Artificial Sequence
  Synthetic
EVQLVESGGGLVQPGGSLRLSCAASGFTFSSYDMHWVRQSTGKGLEWVAVIGTAGDTYYLGSVQGRFTISRENAKNSLYLQMNDLRAGDTAVYYCARANYYGSSGFRHYYYGMDVWGQGITVTVSS

SEQ ID NO: 3031 - protein, 20 aa, Artificial Sequence
  Synthetic
ARANYYGSSGFRHYYYGMDV

SEQ ID NO: 3032 - protein, 108 aa, Artificial Sequence
  Synthetic
EIVMTQSPATLSVSPGERATLSCRASQAVSSNLAWYQQKPGQAPRLLIYGASTRATGIPARFSGSGSGTEFTLTISSLQSEDFAVYFCQQYNNWPPITFGQGTRLEIK

SEQ ID NO: 3033 - protein, 10 aa, Artificial Sequence
  Synthetic
QQYNNWPPIT

SEQ ID NO: 3034 - protein, 115 aa, Artificial Sequence
  Synthetic
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCAREVYAFDIWGQGTMVTVSS

SEQ ID NO: 3035 - protein, 9 aa, Artificial Sequence
  Synthetic
AREVYAFDI

SEQ ID NO: 3036 - protein, 107 aa, Artificial Sequence
  Synthetic
DIQLTQSPSFLSASVGDRVTITCRASQGIGTYLAWYQQKPGKAPKLLIYAASTLQSGVPSRFSGSGSGTDFTLTISSLQPEDFATYCCQQLNSDRYTFGQGTKLEIK

SEQ ID NO: 3037 - protein, 9 aa, Artificial Sequence
  Synthetic
QQLNSDRYT

SEQ ID NO: 3038 - protein, 118 aa, Artificial Sequence
  Synthetic
EVQLVESGGGLIQPGGSLRLSCAASGFTVNSNYMSWVRQAPGKGLEWVSVIYSGGSTYYADSVKGRFTISRDNSKNTLYLQMNSLRAEDTAVYYCARCCIARPGYNSWGQGTLVTVSS

SEQ ID NO: 3039 - protein, 12 aa, Artificial Sequence
  Synthetic
ARCCIARPGYNS

SEQ ID NO: 3040 - protein, 107 aa, Artificial Sequence
  Synthetic
DIQMTQSPSSLSASVGDRVTITCQASQDLSNYLNWYQHKPGKAPKLLIYDTSNLETGVPPRFSGSGSGTDFTFTISSLQPEDIATYYCQQSDNLPYTFGQGTKLEIK

SEQ ID NO: 3041 - protein, 9 aa, Artificial Sequence
  Synthetic
QQSDNLPYT

SEQ ID NO: 3042 - protein, 117 aa, Artificial Sequence
  Synthetic
QLQLQESGPGLVKPSETLSLTCTVSGGSISSSSYYWGWIRQPPGKGLEWIGTIYYSGSTYYNPSLKSRVTISVDTSKNQFSLKLSSVTAADTAVYYCAREMGVHDYWGQGTLVTVSS

SEQ ID NO: 3043 - protein, 9 aa, Artificial Sequence
  Synthetic
AREMGVHDY

SEQ ID NO: 3044 - protein, 108 aa, Artificial Sequence
  Synthetic
DIQMTQSPSSLSASVGDRVTITCRASQGISNSLAWYQQKPGKAPNLLLYAASTLESGVPSRFSGSGSGTDYTLTISSLQPEDFATYYCQQYYSTPPRTFGQGTKVEIK

SEQ ID NO: 3045 - protein, 10 aa, Artificial Sequence
  Synthetic
QQYYSTPPRT

SEQ ID NO: 3046 - protein, 131 aa, Artificial Sequence
  Synthetic
EVQLVESGGGLVQPGRSLRLSCAASGFTFDNYAIHWVRQAPGKGLEWVSGTTWNSGTIGYADSVKGRFTISRDNAKSSLYLQMNSLRAEDTALYYCAKSKEGVYYDILTGYYSDKGPFEYWGQGTLVTVSS

SEQ ID NO: 3047 - protein, 24 aa, Artificial Sequence
  Synthetic
AKSKEGVYYDILTGYYSDKGPFEY

SEQ ID NO: 3048 - protein, 107 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSDSYTFGQGTKLEIK

SEQ ID NO: 3049 - protein, 9 aa, Artificial Sequence
  Synthetic
QQYNSDSYT

SEQ ID NO: 3050 - protein, 125 aa, Artificial Sequence
  Synthetic
EVQLVESGGGLVQPGRSLRLSCAASGFTFEDYAMHWVRQGPGKGLEWVSGISWNSGTIGYADSVKGRFTISRDNAKNSLYLQMNSLRAEDTALYYCAKEKCGGDCYGLGWGMDVWGQGTTVTVSS

SEQ ID NO: 3051 - protein, 18 aa, Artificial Sequence
  Synthetic
AKEKCGGDCYGLGWGMDV

SEQ ID NO: 3052 - protein, 108 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSDPPWTFGQGTKVEIK

SEQ ID NO: 3053 - protein, 10 aa, Artificial Sequence
  Synthetic
QQYNSDPPWT

SEQ ID NO: 3054 - protein, 123 aa, Artificial Sequence
  Synthetic
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDRASSGYQGDDAYDIWGQGTMVTVSS

SEQ ID NO: 3055 - protein, 17 aa, Artificial Sequence
  Synthetic
ARDRASSGYQGDDAYDI

SEQ ID NO: 3056 - protein, 107 aa, Artificial Sequence; identical to SEQ ID NO: 2952
  Synthetic

SEQ ID NO: 3057 - protein, 9 aa, Artificial Sequence
  Synthetic
QQYDNLPPT

SEQ ID NO: 3058 - protein, 117 aa, Artificial Sequence
  Synthetic
QLQLQESGPGLVKPSETLSLTCTVSSGSISSTRYYWGWIRQPPGKGLEWIGSIFYSGSTYYNPSLKSRVTISVDTSKNQFSLKLSSVTAADTAVYYCAREMGMLDYWGQGTLVTVSS

SEQ ID NO: 3059 - protein, 9 aa, Artificial Sequence
  Synthetic
AREMGMLDY

SEQ ID NO: 3060 - protein, 108 aa, Artificial Sequence
  Synthetic
DIQMTQSPSSLSASVGDRVTITCRASQGISNSLAWYQQKPGKAPKLLLYAASTLESGVPSRFSGSGSGTDYTLTISSLQPEDFATYYCQQYYSSPPRTFGQGTKVEIK

SEQ ID NO: 3061 - protein, 10 aa, Artificial Sequence
  Synthetic
QQYYSSPPRT

SEQ ID NO: 3062 - protein, 125 aa, Artificial Sequence
  Synthetic
QVQLVQSGAGVKKPGSSVKVSCKASGGTFSSYGISWVRQAPGQGLEWMGGIIPIFGTTKYAQKFQGRVTITADEATSTAYMELSSLGAEDTAVYYCARSRPLTMILVGTELLDFWGQGTLVLVSS

SEQ ID NO: 3063 - protein, 18 aa, Artificial Sequence
  Synthetic
ARSRPLTMILVGTELLDF

SEQ ID NO: 3064 - protein, 113 aa, Artificial Sequence
  Synthetic
DIVMTQSPDSLAVPLGERATINCKSSQSVLYNSNNKNYLAWYQQKPGQPPKLLIYWASTRESGVPDRFSGSGSGTDFTLTISSLQAEDVAVYYCQQYYSTPLTFGQGTKLEIK

SEQ ID NO: 3065 - protein, 9 aa, Artificial Sequence
  Synthetic
QQYYSTPLT

SEQ ID NO: 3066 - protein, 123 aa, Artificial Sequence
  Synthetic
QVQLVESGGGVVQPGRSLRLSCAASGFTFSIYDMHWVFQAPGMGAEWGVIISYGGTNEFHADSLKGLLSISRDNSKNTLYLQMNSLRAEDTAVYYCAKDIEQWLLLVPVFDYWGQGTLVTVSS

SEQ ID NO: 3067 - protein, 16 aa, Artificial Sequence
  Synthetic
AKDIEQWLLLVPVFDY

SEQ ID NO: 3068 - protein, 102 aa, Artificial Sequence
  Synthetic
DIQMTQSPSSLSASVGDRVTITCRASQSISSYLNWYQQMPGKAPKLLIYAASSLRSGVPSRFSGSGSGTDFTLTISSLQPEDFATYFCQQSYTTPGLTFGGG

SEQ ID NO: 3069 - protein, 10 aa, Artificial Sequence
  Synthetic
QQSYTTPGLT

SEQ ID NO: 3070 - protein, 127 aa, Artificial Sequence
  Synthetic
QVQLVESGGGVVQPGRSLRLSCAASGFTFHNYGMHWVRQAPGKGLEWVALISYDGSNKYSADSVKGRFTISRDTSKTTLYLQMNSLRADDTAVYYCARSQNYYDRSGYLAEDAFDIWGQGTMVTVSS

SEQ ID NO: 3071 - protein, 20 aa, Artificial Sequence
  Synthetic
ARSQNYYDRSGYLAEDAFDI

SEQ ID NO: 3072 - protein, 107 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTTVEIK

SEQ ID NO: 3073 - protein, 9 aa, Artificial Sequence
  Synthetic
QQYNSYPWT

SEQ ID NO: 3074 - protein, 115 aa, Artificial Sequence
  Synthetic
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARAPYGGSIWGQGTMVTVSS

SEQ ID NO: 3075 - protein, 9 aa, Artificial Sequence
  Synthetic
ARAPYGGSI

SEQ ID NO: 3076 - protein, 107 aa, Artificial Sequence; identical to SEQ ID NO: 118
  Synthetic

SEQ ID NO: 3077 - protein, 9 aa, Artificial Sequence
  Synthetic
QQYDNLPIT

SEQ ID NO: 3078 - protein, 123 aa, Artificial Sequence
  Synthetic
QVQLVQSGAEVKKPGASVKVSCKASGYTFSSNYMHWVRQAPGQGLEWMGIINPSGGSTTYAQKFQGRVTMTGDTSTSTVYMELSSLRSEDTAVYYCARDWNFLPTGSHWFDPWGQGTLVTVSS

SEQ ID NO: 3079 - protein, 16 aa, Artificial Sequence
  Synthetic
ARDWNFLPTGSHWFDP

SEQ ID NO: 3080 - protein, 113 aa, Artificial Sequence
  Synthetic
DIVMTQSPVSLAVSLGERATINCKSSQSVLYSSNNKNYLAWYQQKPGQPPRLLIYWASTRESGVPDRFSGSGSGTDFTLTISSLQAEDVAVYYCQQYYSTPLTFGGGTKVEIK

SEQ ID NO: 3081 - protein, 9 aa, Artificial Sequence
  Synthetic
QQYYSTPLT

SEQ ID NO: 3082 - protein, 117 aa, Artificial Sequence
  Synthetic
QLQLQESGPGLVKPSETLSLTCTVSGGSISSSSYYWGWIRQPPGKGLEWIGSIYYSGSTYYNPSLKSRVTISVETSKNQFSLKLSSVTAADTAVYYCARIMGLFDYWGQGTLVTVSS

SEQ ID NO: 3083 - protein, 9 aa, Artificial Sequence
  Synthetic
ARIMGLFDY

SEQ ID NO: 3084 - protein, 108 aa, Artificial Sequence
  Synthetic
DIQMTQSPSSLSASVGDRVTITCRASQGITNSLAWYQQKPGKAPKLLLYAASTLESGVPSRFSGSGSGTDFTLTISSLQPEDFATYYCQQYYSSLLFTFGPGTKVDIK

SEQ ID NO: 3085 - protein, 10 aa, Artificial Sequence
  Synthetic
QQYYSSLLFT

SEQ ID NO: 3086 - protein, 122 aa, Artificial Sequence
  Synthetic
QVQLVESGGGVVQPGRSLRLSCAASGFTFSRYGMHWVRQAPGKGLEWVAVISYDGSNKYYTDSVKGRFTISRDTSKNTLYLQMNSLRPEDTAVYYCAKERGSYYPRGDFDYWGQGTLVTVSS

SEQ ID NO: 3087 - protein, 15 aa, Artificial Sequence
  Synthetic
AKERGSYYPRGDFDY

SEQ ID NO: 3088 - protein, 107 aa, Artificial Sequence
  Synthetic
DIQMTQSPSSLSASVGDRVTITCQASQDISYYLNWYQQKPGKVPKLLIYDASSLETGVPSRFSGSGSGTDFTFTISSLQPEDIATYYCQQYDNLPPAFGGGTKVEIK

SEQ ID NO: 3089 - protein, 9 aa, Artificial Sequence
  Synthetic
QQYDNLPPA

SEQ ID NO: 3090 - protein, 121 aa, Artificial Sequence
  Synthetic
QVQLVESGGGVVQPGRSLRLSCAASGFTFSSYGMHWVRQAPGKGLEWVAVISYDGSFKYYADSVKGRFTISRDNSKNTLYVQMNSLRAEDTAVYYCAKDLESEQQLVPDYWGQGTLVTVSS

SEQ ID NO: 3091 - protein, 14 aa, Artificial Sequence
  Synthetic
AKDLESEQQLVPDY

SEQ ID NO: 3092 - protein, 108 aa, Artificial Sequence; identical to SEQ ID NO: 1652
  Synthetic

SEQ ID NO: 3093 - protein, 10 aa, Artificial Sequence
  Synthetic
QQSYSTPPLT

SEQ ID NO: 3094 - protein, 123 aa, Artificial Sequence
  Synthetic
QVQLVESGGGVVQPGRSLRLSCAASGFTFSSYGIHWVRQAPGKGLEWVAVISYDGSNKYYGDSVKGRFTISRDNSKNTVNMQMNSLRAEDTAVYYCALAPGSYSSGWYYFDYWGQGTLVTVSS

SEQ ID NO: 3095 - protein, 16 aa, Artificial Sequence
  Synthetic
ALAPGSYSSGWYYFDY

SEQ ID NO: 3096 - protein, 107 aa, Artificial Sequence
  Synthetic
DIQMTQSPSSLSASVGDRVTITCRASQSISSYLNWYQQKPGKAPKLLIYDASSLQSGVPSRFSGSGSGTDFTLTISSLQPEDFATYYCQQSYFIPITFGQGTRLEIK

SEQ ID NO: 3097 - protein, 9 aa, Artificial Sequence
  Synthetic
QQSYFIPIT

SEQ ID NO: 3098 - protein, 127 aa, Artificial Sequence
  Synthetic
QVQLVESGGGVVQPGRSLRLSCAASGFTFSRYAMHWVRQAPGKGLEWLAVILYDGSDKYYADSVKGRITISRDNSKNTLYLQMNSLRAEDTAVYYCAKMNGVYCSGGNCYSGYSDYWGQGTLVSVSS

SEQ ID NO: 3099 - protein, 20 aa, Artificial Sequence
  Synthetic
AKMNGVYCSGGNCYSGYSDY

SEQ ID NO: 3100 - protein, 106 aa, Artificial Sequence; identical to SEQ ID NO: 2984
  Synthetic

SEQ ID NO: 3101 - protein, 8 aa, Artificial Sequence
  Synthetic
QQYNSYGT

SEQ ID NO: 3102 - protein, 121 aa, Artificial Sequence
  Synthetic
QVQLQESGPGLVKPSQTLSLTCTVSGGSISSGGFYWSWIRQHPGKGLEWIGYIYYSGSTFYNPSLKSRVTISVGTSKNQFSLRLSSVTAADTAVYYCARDFGGNSNYFAYWGQGTLVTVSS

SEQ ID NO: 3103 - protein, 13 aa, Artificial Sequence
  Synthetic
ARDFGGNSNYFAY

SEQ ID NO: 3104 - protein, 107 aa, Artificial Sequence
  Synthetic
DIQMTQSPSSLSASVGDRVTITCQASQDISKYLSWYQQKPGKAPKLLIYDASNLETGVPSRFSGSGSGTDFTLTISSLQPGDIATYYCQQYDNLPLTFGGGAKVEIK

SEQ ID NO: 3105 - protein, 9 aa, Artificial Sequence
  Synthetic
QQYDNLPLT

SEQ ID NO: 3106 - protein, 125 aa, Artificial Sequence
  Synthetic
QVQLVQSGAEVKKPGASVKVSCKASGYTFTGFYMHWVRQAPGQGLEWMGWINPNSGGTKYAQKFQGRVTMTRDTSISTAYMELSRLRSDDTAVYYCAKDWGCSGGYCSPEYFDYWGQGTLVTVSS

SEQ ID NO: 3107 - protein, 18 aa, Artificial Sequence
  Synthetic
AKDWGCSGGYCSPEYFDY

SEQ ID NO: 3108 - protein, 106 aa, Artificial Sequence
  Synthetic
DIQMTQSPSTLSASVGDRVTITCRASQSISSWLAWYQQKPGKAPKLLIYKAFSLETGVPSRFSGSGSGTEFTLTISSLQPDDFATYYCQQYNTLVGFGQGTKVEIK

SEQ ID NO: 3109 - protein, 8 aa, Artificial Sequence
  Synthetic
QQYNTLVG

SEQ ID NO: 3110 - protein, 118 aa, Artificial Sequence
  Synthetic
EVQLVESGGGLIQPGGSLRLSCAASGLIVSSNYMFWVRQAPGKGLEWVSVIYSGGSTFYADSVKGRFTISRDSSKNTLYLQMNSLRAEDTAVYYCARDLGARGGFDIWGQGTMVTVSS

SEQ ID NO: 3111 - protein, 12 aa, Artificial Sequence
  Synthetic
ARDLGARGGFDI

SEQ ID NO: 3112 - protein, 106 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLDTFPLFGGGTKVEIK

SEQ ID NO: 3113 - protein, 8 aa, Artificial Sequence
  Synthetic
QQLDTFPL

SEQ ID NO: 3114 - protein, 117 aa, Artificial Sequence
  Synthetic
EVQLVESGGGLIQPGGSLRLSCAASGFIVSSNYMNWVRQAPGKGLEWVSVIYSGGSTYYADSVKGRFTISRDNSKNTLYLQMNSLRAEDTAVYYCARSYGDYYFDYWGQGTLVTVSS

SEQ ID NO: 3115 - protein, 11 aa, Artificial Sequence
  Synthetic
ARSYGDYYFDY

SEQ ID NO: 3116 - protein, 107 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIK

SEQ ID NO: 3117 - protein, 8 aa, Artificial Sequence
  Synthetic
QQYGSSLT

SEQ ID NO: 3118 - protein, 124 aa, Artificial Sequence
  Synthetic
QVQLQESGPGLVKPSQTLSLTCTVSGGSISSGGYYWSWIRQHPGKGLEWIGYIYYSGSTYYNPSLESRVTISVDTSKNQFSLKLSSVTAADTAVYYCARGPYNSRWYRSWFDPWGQGTLVTVSS

SEQ ID NO: 3119 - protein, 16 aa, Artificial Sequence
  Synthetic
ARGPYNSRWYRSWFDP

SEQ ID NO: 3120 - protein, 107 aa, Artificial Sequence
  Synthetic
DIQMTQSPSSLSASIGDRVTITCQASQDISNYLNWYQQKPGKAPKLLIYDASNLETGVPSRFSGSGSGTDFTLTISSLQPEDIATFYCQQYGNLPYTFGQGTRLEIK

SEQ ID NO: 3121 - protein, 9 aa, Artificial Sequence
  Synthetic
QQYGNLPYT

SEQ ID NO: 3122 - protein, 122 aa, Artificial Sequence
  Synthetic
EVQLVESGGGLVQPGGSLRLSCLASGFTFSSYDMHWVRPAAGKGLEWVSAIGTYGDTYYPDSVKGRFTISRENAKNSLYLQMNSLTAGDTAVYFCARVDYDTSGYYYFFDSWGQGTLVTVSS

SEQ ID NO: 3123 - protein, 16 aa, Artificial Sequence
  Synthetic
ARVDYDTSGYYYFFDS

SEQ ID NO: 3124 - protein, 108 aa, Artificial Sequence
  Synthetic
DIQMTQSPSSLSASVGDRVTITCRASQSIGSYLNWYQQKPGKAPKLLIYVASSLQSGVPSRFSGSGSGTDFTLTISSLQPEDFATYYCQQSYNTPPITFGQGTRLEIK

SEQ ID NO: 3125 - protein, 10 aa, Artificial Sequence
  Synthetic
QQSYNTPPIT

SEQ ID NO: 3126 - protein, 121 aa, Artificial Sequence
  Synthetic
QVQLVESGGGVVQPGRSLRLSCAASGFTFSSYGMHWVRQAPGKGLEWVAVISYDGSNKFYADSVKGRFTISRDNSKNTLYLQMNSLRAEDTALYYCAKDRDLEWLLLVDYWGQGTLVTVSS

SEQ ID NO: 3127 - protein, 14 aa, Artificial Sequence
  Synthetic
AKDRDLEWLLLVDY

SEQ ID NO: 3128 - protein, 108 aa, Artificial Sequence; identical to SEQ ID NO: 1652
  Synthetic

SEQ ID NO: 3129 - protein, 10 aa, Artificial Sequence
  Synthetic
QQSYSTPPLT

SEQ ID NO: 3130 - protein, 117 aa, Artificial Sequence
  Synthetic
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARIMGLFDYWGQGTLVTVSS

SEQ ID NO: 3131 - protein, 9 aa, Artificial Sequence
  Synthetic
ARIMGLFDY

SEQ ID NO: 3132 - protein, 108 aa, Artificial Sequence
  Synthetic
DIQMTQSPSSLSASVGDRVTITCRASQGISNSLAWYQQKPGKAPNLLLYAASTLESGVPSRFSGSGSGTDYTLTISSLQPEDFATYYCQQYYSTLLFTFGPGTKVDIK

SEQ ID NO: 3133 - protein, 10 aa, Artificial Sequence
  Synthetic
QQYYSTLLFT

SEQ ID NO: 3134 - protein, 121 aa, Artificial Sequence
  Synthetic
EVQLVESGGGLIQPGGSLRLSCAVSGFTVISNYMSWVRQAPGKGLEWVSVIYSGGSTDYADSVKGRFTISRDNSKNTLYLHMNSLRAEDTAVYYCAREAPLGRAPMVFDYWGQGTLVTVSS

SEQ ID NO: 3135 - protein, 15 aa, Artificial Sequence
  Synthetic
AREAPLGRAPMVFDY

SEQ ID NO: 3136 - protein, 107 aa, Artificial Sequence
  Synthetic
DIQLTQSPSFLSASVGDRVTITCRASQGISIYLAWYQQKPGKAPKFLIYGASTLQSGVPSRFSGSGSGTDFTLTISSLQPEDFATYYCQQLNSYPPTFGGGTKVEIK

SEQ ID NO: 3137 - protein, 9 aa, Artificial Sequence
  Synthetic
QQLNSYPPT

SEQ ID NO: 3138 - protein, 117 aa, Artificial Sequence
  Synthetic
EVQLVESGGGLIQPGGSLRLSCAASGITVSANYMTWVRQAPGKGLEWVSLIYSGGSTYYADSVKGRFTISRDNSKNTLYLQMNSLRAEDTAVYYCARDLVVYGLDVWGQGTTVTVSS

SEQ ID NO: 3139 - protein, 11 aa, Artificial Sequence
  Synthetic
ARDLVVYGLDV

SEQ ID NO: 3140 - protein, 107 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGNSPIFGGGTKVEIK

SEQ ID NO: 3141 - protein, 8 aa, Artificial Sequence
  Synthetic
QQYGNSPI

SEQ ID NO: 3142 - protein, 121 aa, Artificial Sequence
  Synthetic
EVQLVESGGGLIQPGGSLRLSCAASGFTVSSNYMSWVRQAPGKGLECVSVLYSSVLYSGGGTFYADSVKGRFIISRDNSKNTLYLQMNSLRAEDTAVYYCARIVSDAFDIWGQGTMVTVSS

SEQ ID NO: 3143 - protein, 10 aa, Artificial Sequence
  Synthetic
ARIVSDAFDI

SEQ ID NO: 3144 - protein, 107 aa, Artificial Sequence
  Synthetic
DIQMTQSPSTLSASVGDRVTITCRASQSISSWLAWYQQKPGKAPKLLIYKASNLESGVPSRFSGSGSGTEFTLTITSLQPDDFATYYCQQYNGYSYTFGQGTKLEIK

SEQ ID NO: 3145 - protein, 9 aa, Artificial Sequence
  Synthetic
QQYNGYSYT

SEQ ID NO: 3146 - protein, 128 aa, Artificial Sequence
  Synthetic
QLQLQESGPGLVKPSETLSLTCTVSGGSISSSNYYWGWIRQPPGKGLEWIGSFYYSGSTYYNPSLKSRVTISVDTSKNLCSLQLSSVTAADTAVYYCARHEYYYDRRGYPRLGWFDPWGQGTLVTVSS

SEQ ID NO: 3147 - protein, 20 aa, Artificial Sequence
  Synthetic
ARHEYYYDRRGYPRLGWFDP

SEQ ID NO: 3148 - protein, 106 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLVTFGPGTKVDIK

SEQ ID NO: 3149 - protein, 8 aa, Artificial Sequence
  Synthetic
QQYDNLVT

SEQ ID NO: 3150 - protein, 117 aa, Artificial Sequence
  Synthetic
EVQLVESGGGLIQPGGSLRLSCAASGLTVSSNYMSWVRQAPGKGLEWVSVIYSGGSTFYADSVKGRFTISRDNSKNTLYLQMNSLRAEDTAVYYCARDLQSYGMDVWGQGTTVTVSS

SEQ ID NO: 3151 - protein, 11 aa, Artificial Sequence
  Synthetic
ARDLQSYGMDV

SEQ ID NO: 3152 - protein, 106 aa, Artificial Sequence
  Synthetic
DIQLTQSPSFLSASVGDRVTITCRASQGISSYLAWYQQKPGKAPKLLIYDASTLQSGVPSRFSGSGSGTDFTLTISSLQPEDFATYYCQELNSYPVFGGGTKVEIK

SEQ ID NO: 3153 - protein, 8 aa, Artificial Sequence
  Synthetic
QELNSYPV

SEQ ID NO: 3154 - protein, 123 aa, Artificial Sequence
  Synthetic
QVQLVESGGGVVHPGRSLRLSCAASGFTFSNYGIHWVRQAPGKGLEWVALISYDGSNEYYTGSVKGRFTISRDNSKNTLYLQMNSLRAEDTAVYYCAKDLYYYGSGSYVFDFWGQGTLVTVSS

SEQ ID NO: 3155 - protein, 16 aa, Artificial Sequence
  Synthetic
AKDLYYYGSGSYVFDF

SEQ ID NO: 3156 - protein, 108 aa, Artificial Sequence
  Synthetic
DIQMTQSPSSLSASVGDRVTITCQASQDIRNFLNWYQQKPGKAPKLLIYDASNLETGVPSRFSGSGSGTDFTFTISSLQPEDIATYYCQQYDNLPPITFGQGTRLEIK

SEQ ID NO: 3157 - protein, 10 aa, Artificial Sequence
  Synthetic
QQYDNLPPIT

SEQ ID NO: 3158 - protein, 118 aa, Artificial Sequence
  Synthetic
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLEVAGGMDVWGQGTTVTVSS

SEQ ID NO: 3159 - protein, 12 aa, Artificial Sequence
  Synthetic
ARDLEVAGGMDV

SEQ ID NO: 3160 - protein, 107 aa, Artificial Sequence
  Synthetic
DIQLTQSPSFLSASVGDRVTITCRASQGISSYLAWFQQKPGKAPKLLIYAASTLQSGVPSRFSGSGSGTDFTLTISSLQPEDFATYYCQQLNSYPLTFGGGTKVEIK

SEQ ID NO: 3161 - protein, 9 aa, Artificial Sequence
  Synthetic
QQLNSYPLT

SEQ ID NO: 3162 - protein, 116 aa, Artificial Sequence
  Synthetic
EVQLVESGGGLIQPGGSLRLSCAASVFTVSSNYMTWVRQAPGKGLEWVSVIYSGGSTYYADSVKGRFTISRDNSKNTLYLQMNSLRAEDTAVYYCARKLRGYFDYWGQGTLVTVSS

SEQ ID NO: 3163 - protein, 10 aa, Artificial Sequence
  Synthetic
ARKLRGYFDY

SEQ ID NO: 3164 - protein, 108 aa, Artificial Sequence
  Synthetic
DIQMTQSPSSLSASVGDRVTITCRASQGISNSLAWYQQKPGKAPKLLLYAASRLESGVPSRFSGSGSGTDYTLTISSLQPEDFATYYCQQYYSTPQVTFGGGTKVEIK

SEQ ID NO: 3165 - protein, 10 aa, Artificial Sequence
  Synthetic
QQYYSTPQVT

SEQ ID NO: 3166 - protein, 118 aa, Artificial Sequence
  Synthetic
EVQLVESGGGLIQPGGSLRLSCAASGLTVSRNYMNWVRQAPGKGLEWVSVIYSGGSTFYADSVKGRFTISRDNSNNTLYLQMNSLRADDTAVYYCARDLELAGGIDVWGQGTTVTVSS

SEQ ID NO: 3167 - protein, 12 aa, Artificial Sequence
  Synthetic
ARDLELAGGIDV

SEQ ID NO: 3168 - protein, 107 aa, Artificial Sequence
  Synthetic
DIQLTQSPSFLSASVGDRVTITCRASQGISSYLAWYQQKPGKAPKVLIYAASTLQSGVPSRFSGSGSGTDFTLTISSLQPEDFATYYCQQLNSYPLTFGGGTKVEIK

SEQ ID NO: 3169 - protein, 9 aa, Artificial Sequence
  Synthetic
QQLNSYPLT

SEQ ID NO: 3170 - protein, 122 aa, Artificial Sequence; identical to SEQ ID NO: 2890
  Synthetic

SEQ ID NO: 3171 - protein, 15 aa, Artificial Sequence
  Synthetic
AKAYYYGSGSYWFDL

SEQ ID NO: 3172 - protein, 113 aa, Artificial Sequence; identical to SEQ ID NO: 2892
  Synthetic

SEQ ID NO: 3173 - protein, 9 aa, Artificial Sequence
  Synthetic
QQYYSTPLT

SEQ ID NO: 3174 - protein, 125 aa, Artificial Sequence
  Synthetic
EVQLVESGGALVQPGRSLRLSCAASGFTFDDYAIHWVRQAPGKGLEWVSGVSWNSAIIGYADSVKGRFTISRDNAKNSLYLQMNSLRAEDTALYYCAKEKCAGDCYGLGWGLDVWGQGTTVTVSS

SEQ ID NO: 3175 - protein, 18 aa, Artificial Sequence
  Synthetic
AKEKCAGDCYGLGWGLDV

SEQ ID NO: 3176 - protein, 108 aa, Artificial Sequence
  Synthetic
DIQMTQSPSTLSASIGDRVTITCRASQSISSWLAWYQQKPGRTPKLLIYKASSLESGVPSRFSGSGSGTEFTLTISSLQPDDFATYYCQQYNSYPPWTFGQGTKVEIK

SEQ ID NO: 3177 - protein, 10 aa, Artificial Sequence
  Synthetic
QQYNSYPPWT

SEQ ID NO: 3178 - protein, 126 aa, Artificial Sequence
  Synthetic
QVQLVQSGAEVKKPGASVKVSCKASGYTFTSYGISWVRQAPGQGLEWMGWISAYEGNTNYAQKFQGRVTMTTDTSTSTVYMELRSLRSDDTAVYYCARVKDYYGSSGYSSYYFDSWGQGTLVTVSS

SEQ ID NO: 3179 - protein, 19 aa, Artificial Sequence
  Synthetic
ARVKDYYGSSGYSSYYFDS

SEQ ID NO: 3180 - protein, 109 aa, Artificial Sequence
  Synthetic
AIQMTQSPSSLSASVGDRVTITCRASQDIRNDLGWYQQKPGKAPKLLIYDASSLQSGVPSRFSGSGSGTDFTLTISSLQPEDFATYYCLQNYDYPPIFTFGPGTKVDIK

SEQ ID NO: 3181 - protein, 11 aa, Artificial Sequence
  Synthetic
LQNYDYPPIFT

SEQ ID NO: 3182 - protein, 123 aa, Artificial Sequence
  Synthetic
QVQLVQSGAEVKKPGSSVKVSCKASGGTFSSYAISWVRQAPGQGLEWMGGIIPLFGTANYAQKFHGRLTITADESTSTAYMDLSSLRSEDTAVYYCARFGTLHDSDGYMVDYWGQGTLVSVSS

SEQ ID NO: 3183 - protein, 16 aa, Artificial Sequence
  Synthetic
ARFGTLHDSDGYMVDY

SEQ ID NO: 3184 - protein, 107 aa, Artificial Sequence
  Synthetic
EIVLTQSPGTLSLSPGERATLSCRASQSVSRNYLAWYQQKPGQAPRLLIYDASSRATGIPDRFSGSGSGTDFTLTISRLEPEDFAVYYCQQYGTSRTFGQGTKVEIK

SEQ ID NO: 3185 - protein, 8 aa, Artificial Sequence
  Synthetic
QQYGTSRT

SEQ ID NO: 3186 - protein, 120 aa, Artificial Sequence
  Synthetic
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGRDDSSGWNFDYWGQGTLVTVSS

SEQ ID NO: 3187 - protein, 14 aa, Artificial Sequence
  Synthetic
ARGRDDSSGWNFDY

SEQ ID NO: 3188 - protein, 108 aa, Artificial Sequence
  Synthetic
DIQMTQSPSSLSASVGDRVTITCRASQGIRNSLAWYQQKPGKAPKLLLYAASRLENGVPSRFSGSGSGTDYTLTISSLQPEDFATYYCQQYYSNPSPTFGGGTKVEIK

SEQ ID NO: 3189 - protein, 10 aa, Artificial Sequence
  Synthetic
QQYYSNPSPT

SEQ ID NO: 3190 - protein, 127 aa, Artificial Sequence
  Synthetic
QVQLVESGGGVVQPGRSLRLSCAASGFTFSNYGMHWVRQAPGKGLQWVAVIRFDGSNKYYADSVKGRFTISRDNSKTTLYLQMNSLRAEDTAVYYCARSQNYYDRSGSLAEDAFDIWGQGTMVTVSS

SEQ ID NO: 3191 - protein, 20 aa, Artificial Sequence
  Synthetic
ARSQNYYDRSGSLAEDAFDI

SEQ ID NO: 3192 - protein, 107 aa, Artificial Sequence
  Synthetic
DIQMTQSPSSLSASVGDRVTITCRASQGISNYLAWFQQKPGKAPKSLIYAASSLQSGVPSRFSGSGSGTDFTLTISSLQPEDFATYYCQQYNSYPWTFGQGTKVEIK

SEQ ID NO: 3193 - protein, 9 aa, Artificial Sequence
  Synthetic
QQYNSYPWT

SEQ ID NO: 3194 - protein, 117 aa, Artificial Sequence
  Synthetic
QLQLQESGPGLVKPSETLSLTCTVSGGSISSSTYYWGWIRQPPGKGLEWIGSMFYTGSTYYNPSLKSRVTISVDTSKNQFSLKLSSVTAADTAVYYCARHLGAFDVWGQGTMVTVSS

SEQ ID NO: 3195 - protein, 9 aa, Artificial Sequence
  Synthetic
ARHLGAFDV

SEQ ID NO: 3196 - protein, 108 aa, Artificial Sequence
  Synthetic
DIQMTQSPSSLSASVGDRVTITCRASQGITNSLAWYQQKPGQAPELLLYAASTLESGVPSRFSGSGSGTDFTLTISGLQPEDFATYYCQQYYSNPPTTFGQGTKVETK

SEQ ID NO: 3197 - protein, 10 aa, Artificial Sequence
  Synthetic
QQYYSNPPTT

SEQ ID NO: 3198 - protein, 124 aa, Artificial Sequence
  Synthetic
QVQLVESGGGVVQPGRSLRLSCAASGFTFSSFAMHWVRQAPGKGLEWVAVISYDGGYKYYADSVKGRFTISRDNSKNTLYLQMNSLRAEDTAVYYCASQKGSRLSYYYYGMDVWGQGTTVTVSS

SEQ ID NO: 3199 - protein, 17 aa, Artificial Sequence
  Synthetic
ASQKGSRLSYYYYGMDV

SEQ ID NO: 3200 - protein, 105 aa, Artificial Sequence
  Synthetic
DIQMTQSPLSASVGDRVTITCRASQSIFSYLNWYQQKPGKAPKLLIYAASSLQSGVPSRFSGSGSGTDFTLTISSLQPEDFATYYCQQSYSTPPAFGQGTKVEIK

SEQ ID NO: 3201 - protein, 9 aa, Artificial Sequence
  Synthetic
QQSYSTPPA

SEQ ID NO: 3202 - protein, 125 aa, Artificial Sequence
  Synthetic
QVQLVQSGAEVKKPGSSVKVSCKASGGTFSSYAISWVRQAPGQGLEWMGGIIPIFGRVDYTQKFQGRVTFTADESTSTAYMELSSLRSEDTAVYYCATWNDYYDSSGGLYYFDYWGQGTLVTVSS

SEQ ID NO: 3203 - protein, 18 aa, Artificial Sequence
  Synthetic
ATWNDYYDSSGGLYYFDY

SEQ ID NO: 3204 - protein, 107 aa, Artificial Sequence
  Synthetic
EIVLTQSPGTLSLSPGERATLSCRASQSVSSNYLAWYQQKPGQAPSLLIYGASSRAAGIPARFSGSGSGTDFTLTISRLEPEDFAVYYCQQYGSSRRFGQGTKVEIK

SEQ ID NO: 3205 - protein, 8 aa, Artificial Sequence
  Synthetic
QQYGSSRR

SEQ ID NO: 3206 - protein, 127 aa, Artificial Sequence
  Synthetic
QVQLVESGGGVVQPGRSLRLSCAASGFTFSTYGMHWVRQAPGKGLEWVAVISYDGSEKYYADSVKGRFTISRDNSKSTLYLQMNSLRAEDTAVYYCAKQRGPYCSGGSCYSGEFDYWGQGTLVTVSS

SEQ ID NO: 3207 - protein, 20 aa, Artificial Sequence
  Synthetic
AKQRGPYCSGGSCYSGEFDY

SEQ ID NO: 3208 - protein, 108 aa, Artificial Sequence; identical to SEQ ID NO: 2912
  Synthetic

SEQ ID NO: 3209 - protein, 10 aa, Artificial Sequence
  Synthetic
QQYDNLPPYT

SEQ ID NO: 3210 - protein, 129 aa, Artificial Sequence
  Synthetic
QLQLQESGPGLVKPSETLSLTCTVSGGSIRSTGHLWGWIRQSPGKGLEWIGNIYYSGSTYYNPSLKSRVTISVDTSKNQFSLKLSSVTAADTAVYYCARQEHYYDRSGYPRSDYAFEIWGQGTMVTVSS

SEQ ID NO: 3211 - protein, 21 aa, Artificial Sequence
  Synthetic
ARQEHYYDRSGYPRSDYAFEI

SEQ ID NO: 3212 - protein, 107 aa, Artificial Sequence
  Synthetic
DIQMTQSPSTLSASVGARVTITCRASQSISSWLAWYQQKPGKAPKLLIYKASNLESGVPSRFSGSGSGTEFTLAISSLQPDDFATYYCQQYSGYPWTFGQGTKVEVK

SEQ ID NO: 3213 - protein, 9 aa, Artificial Sequence
  Synthetic
QQYSGYPWT

SEQ ID NO: 3214 - protein, 129 aa, Artificial Sequence; identical to SEQ ID NO: 2870
  Synthetic

SEQ ID NO: 3215 - protein, 22 aa, Artificial Sequence
  Synthetic
ATNAITFGGVIALGGYYYGMDV

SEQ ID NO: 3216 - protein, 113 aa, Artificial Sequence
  Synthetic
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 3217 - protein, 9 aa, Artificial Sequence
  Synthetic
QQYYSTPLT

SEQ ID NO: 3218 - protein, 116 aa, Artificial Sequence
  Synthetic
EVQLVESGGGLVQPGGSLRLSCAASGFTFSRYWMSWVRQAPGKGLEWVANIKQDGSEKYYVDSVKGRFTISRDNAKNSLYLQMNNLRAEDTAVYYCASGLGAHFYWGQGTLVTVSS

SEQ ID NO: 3219 - protein, 9 aa, Artificial Sequence
  Synthetic
ASGLGAHFY

SEQ ID NO: 3220 - protein, 108 aa, Artificial Sequence
  Synthetic
DIQMTQSPSSLSASVGDRVTITCRASQGISNSLAWYQQKPGKAPKLLLYAASTLESGVPSRFSGSGSGTDYTLTISSLQPEDFATYYCQQYYSTLTWTFGQGTKVEIK

SEQ ID NO: 3221 - protein, 10 aa, Artificial Sequence
  Synthetic
QQYYSTLTWT

SEQ ID NO: 3222 - protein, 130 aa, Artificial Sequence
  Synthetic
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDPEEGGFTIFGVVIIRGGMDVWGQGTTVTVSS

SEQ ID NO: 3223 - protein, 23 aa, Artificial Sequence
  Synthetic
ARDPEEGGFTIFGVVIIRGGMDV

SEQ ID NO: 3224 - protein, 110 aa, Artificial Sequence
  Synthetic
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGLVFGGGTKLTVL

SEQ ID NO: 3225 - protein, 11 aa, Artificial Sequence
  Synthetic
AAWDDSLSGLV

SEQ ID NO: 3226 - protein, 121 aa, Artificial Sequence
  Synthetic
EVQLVQSGAEVKKPGESLKISCKASGYSFISHWIGWVRQMPGKGLEWMGIIYPGDSDTIYSPSFQGQVTISADRSITTAYLQWSSLKASDTAIYYCARRDSGSYSGYFAYWGQGTLVTVSS

SEQ ID NO: 3227 - protein, 14 aa, Artificial Sequence
  Synthetic
ARRDSGSYSGYFAY

SEQ ID NO: 3228 - protein, 111 aa, Artificial Sequence
  Synthetic
QSVLTQPPSASGTPGQRVTISCSGRSSNIGSNPVNWYQQFPGTAPKLLISHNNQRPSGVPDRFSGSKSGTSASLAISGLQSEDEADYYCAAWDDSLNGLYVFGPGTKVTVL

SEQ ID NO: 3229 - protein, 12 aa, Artificial Sequence
  Synthetic
AAWDDSLNGLYV

SEQ ID NO: 3230 - protein, 130 aa, Artificial Sequence
  Synthetic
EVQLVESGGGLVQPGRSLRLSCTASGFTFGDSAMSWFRQAPGKGLEWVGFIRRKAYAGTREYAASVKGRFIISRDDSKSIAYLQMNSLKAEDTAVYYCARGGTPGPDIVVIPAAVGIDYWGQGTLVTVSS

SEQ ID NO: 3231 - protein, 21 aa, Artificial Sequence
  Synthetic
ARGGTPGPDIVVIPAAVGIDY

SEQ ID NO: 3232 - protein, 110 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 3233 - protein, 11 aa, Artificial Sequence
  Synthetic
GTWDSSLSAVV

SEQ ID NO: 3234 - protein, 122 aa, Artificial Sequence
  Synthetic
QVQLVQSGAEVKKPGASVKVSCKASGYTFTSYDINWVRQATGQGLEWMGWMNPNNGNTGYAQKFQGRVTMTRNTSITTAYMELSSLKSEDTAVYYCARGFAYSSNWNHFDYWGQGTLVTVSS

SEQ ID NO: 3235 - protein, 15 aa, Artificial Sequence
  Synthetic
ARGFAYSSNWNHFDY

SEQ ID NO: 3236 - protein, 110 aa, Artificial Sequence
  Synthetic
SYVLTQPPSVSLAPGQTARITCGGNNIGSKNVHWYQQKPGQAPVLVVYDDSDRPSGIPERFSGSNSGNTATLTISRVGAGDEADYYCQVWDSSGDRPDVVFGGGTKLTVL

SEQ ID NO: 3237 - protein, 13 aa, Artificial Sequence
  Synthetic
QVWDSSGDRPDVV

SEQ ID NO: 3238 - protein, 129 aa, Artificial Sequence
  Synthetic
EVQLVESGGGLVQPGRSLRLSCAASGFTFGDYAMHWVRQAPGKGLEWVSGISWNSGRIAYADSVKGRFIISRDNAKNSLYLQMNSLRAEDTAFYYCAKAYCGGDCYNMILGPNDAFDIWGQGTMVTVSS

SEQ ID NO: 3239 - protein, 22 aa, Artificial Sequence
  Synthetic
AKAYCGGDCYNMILGPNDAFDI

SEQ ID NO: 3240 - protein, 107 aa, Artificial Sequence
  Synthetic
SYVLTQPPSVSVAPGQTARITCGGNNIGSQSVHWYQQKPGQAPVLVVYDDSDRPSGIPERFSGSNSGNTATLTISRVEAGDEADYYCQVWDTSTYVVFGGGTKLTVL

SEQ ID NO: 3241 - protein, 10 aa, Artificial Sequence
  Synthetic
QVWDTSTYVV

SEQ ID NO: 3242 - protein, 130 aa, Artificial Sequence
  Synthetic
EVQLLESGGGLVQPGGSLRLSCAASGFTFTSYALSWVRQAPGKGLEWVSAISGSGGSTYYADSVKGRITVSRDNSKNTLYLQMNTLRAEDTAVYYCAKTLATPWTLIEWLRLQEVQMDVWGQGTTVTVSS

SEQ ID NO: 3243 - protein, 23 aa, Artificial Sequence
  Synthetic
AKTLATPWTLIEWLRLQEVQMDV

SEQ ID NO: 3244 - protein, 111 aa, Artificial Sequence
  Synthetic
NFMLTQPHSVSESPGKTVTISCTRSSGSIASNYVHWYQQRPGGAPTTVIYEDNQRPSGVPDRFSGSIDSSSNSASLTISGLKTEDEADYYCQSYDSRYHVVFGGGTKLTVL

SEQ ID NO: 3245 - protein, 10 aa, Artificial Sequence
  Synthetic
QSYDSRYHVV

SEQ ID NO: 3246 - protein, 131 aa, Artificial Sequence
  Synthetic
EVQLVESGGGLVQPGRSLRLSCAASGFTFDDYAMHWVRQAPGKGLEWVSGISWNSGSIGYADSVKGRFTISRDNAKNSLYLQMNSLRPEDTALYYCAKDRRMAVPFLSGSPKEEDYGMDVWGQGTTVTVSS

SEQ ID NO: 3247 - protein, 24 aa, Artificial Sequence
  Synthetic
AKDRRMAVPFLSGSPKEEDYGMDV

SEQ ID NO: 3248 - protein, 110 aa, Artificial Sequence
  Synthetic
QSVLTQPASVSGSPGQSITISCTGTSSDVGGYNYVSWYQQHPGNAPKLMISEVSDRPSGVSNRFSGSKSGNTASLTISGLQAEDEADYYCSSYTSSSTVVFGGGTKLTVL

SEQ ID NO: 3249 - protein, 10 aa, Artificial Sequence
  Synthetic
SSYTSSSTVV

SEQ ID NO: 3250 - protein, 125 aa, Artificial Sequence
  Synthetic
EVQLVESGGGLVQPGRSLRLSCAASGFTFEDYAMHWVRQAPGKGLEWVSGVTWNSGTIGYADSVKGRFIISRDNARNSLYLQMNRLRAEDTALYFCAKDRGAIDVVPENYNFDYWGQGTLVTVSS

SEQ ID NO: 3251 - protein, 18 aa, Artificial Sequence
  Synthetic
AKDRGAIDVVPENYNFDY

SEQ ID NO: 3252 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDLVVFGGGTKLTVL

SEQ ID NO: 3253 - protein, 11 aa, Artificial Sequence
  Synthetic
QVWDSSSDLVV

SEQ ID NO: 3254 - protein, 129 aa, Artificial Sequence
  Synthetic
EVQLVESGGGLVQPGRSLRLSCAASGFTFDDYAMHWVRQAPGKGLEWVSGISWNSGTIGYADSVKGRFTISRDNAKSSLYLQMNSLRAEDTAMYYCAKDVSQVSKWELRRGSLHGFDFWGQGTMVTVSS

SEQ ID NO: 3255 - protein, 22 aa, Artificial Sequence
  Synthetic
AKDVSQVSKWELRRGSLHGFDF

SEQ ID NO: 3256 - protein, 111 aa, Artificial Sequence
  Synthetic
SYVLTQPPSVSVAPGQTARITCGGSIIGSTVFTGTSWYQQKPGQAPLLVVYDDSDRPSGIPERFSGSNSGNTATLTISRVEAGDEADYYCQVWDSSSDHVVFGGGTKLTVL

SEQ ID NO: 3257 - protein, 11 aa, Artificial Sequence
  Synthetic
QVWDSSSDHVV

SEQ ID NO: 3258 - protein, 117 aa, Artificial Sequence
  Synthetic
QVQLVQSGAEVKKPGASVKVSCKASGYTFTTYGISWVRQAPGQGLEWMGWISAYNGNTNYAQKLQGRVTMTTDTSTATAYMELRSLRSDDTAVYYCASLGQVETGYWGQGTLVTVSS

SEQ ID NO: 3259 - protein, 10 aa, Artificial Sequence
  Synthetic
ASLGQVETGY

SEQ ID NO: 3260 - protein, 110 aa, Artificial Sequence
  Synthetic
QSVLTQEPSLTVSPGGTVTLTCGSSTGAVTSGHSPYWFQQKPGQAPRTLIYDTSNKYSWTPARFSGSLLGGKAALTLSGAQPEDEADYYCLLSYSGARVVFGGGTKLTVL

SEQ ID NO: 3261 - protein, 10 aa, Artificial Sequence
  Synthetic
LLSYSGARVV

SEQ ID NO: 3262 - protein, 120 aa, Artificial Sequence
  Synthetic
EVQLVESGGGLVQPGRSLRLSCAASGFIFDDYAMHWVRQAPGKGLEWVSGISWNSDSIGYADSVKGRFTISRDNGKNSLYLQMNSLRAEDTALYYCAKEGDGSTWYLDYWGQGTPVTVSS

SEQ ID NO: 3263 - protein, 13 aa, Artificial Sequence
  Synthetic
AKEGDGSTWYLDY

SEQ ID NO: 3264 - protein, 109 aa, Artificial Sequence
  Synthetic
SYVLTQPPSVSVAPGQTARITCGGNNIGSKSVHWYQQQPGQAPVLVVYDDSARPSGIPERFSGSNSGNTATLTISRVEAGDEADYYCQVWDSTSDHHYVFGTGTKVTVL

SEQ ID NO: 3265 - protein, 12 aa, Artificial Sequence
  Synthetic
QVWDSTSDHHYV

SEQ ID NO: 3266 - protein, 119 aa, Artificial Sequence
  Synthetic
QVQLVQSGAEVKKPGASVKVSCKASGYTFTSHDINWVRQATGQGLEWMGWMNPNTGNTGYAQKFQGRVAMTRNTSTSTAYMELSSLRSEDTAVYYCARVSTLTYYYDQWGQGTLVTVSS

SEQ ID NO: 3267 - protein, 12 aa, Artificial Sequence
  Synthetic
ARVSTLTYYYDQ

SEQ ID NO: 3268 - protein, 110 aa, Artificial Sequence
  Synthetic
SYVLTQPPSVSVAPGQTARITCGGSNIGSKSVHWYQQKPGQAPVLVVYDDSDRPSGIPERFSGSNSGNTAALTISGVEAGDEADYYCQVWDSTTDHPHVVFGGGTKLTVL

SEQ ID NO: 3269 - protein, 13 aa, Artificial Sequence
  Synthetic
QVWDSTTDHPHVV

SEQ ID NO: 3270 - protein, 120 aa, Artificial Sequence
  Synthetic
QVQLVQSGAEVKKPGASVKVSCKASGYTFTNYDINWVRQATGQGLEWMGWMNPNSGNTGYAQKFQGRVTMTGDTSISIAYMELNSLRSEDTAVYYCARVSSSLTYYFDYWGQGTLVTVSS

SEQ ID NO: 3271 - protein, 13 aa, Artificial Sequence
  Synthetic
ARVSSSLTYYFDY

SEQ ID NO: 3272 - protein, 110 aa, Artificial Sequence
  Synthetic
SYVLTQPPSVSVAPGQTARIACGGNYIGSKSVHWYQQRPGQAPVLVVYDDSDRPSGIPERFSGSNSGNTATLTISRVEAGDEADYYCQVWDSTTDHPHVVFGGGTRLTVL

SEQ ID NO: 3273 - protein, 13 aa, Artificial Sequence
  Synthetic
QVWDSTTDHPHVV

SEQ ID NO: 3274 - protein, 126 aa, Artificial Sequence
  Synthetic
QVQLVESGGGVVQPGRSLRLSCAASGFTFSTYALHWVRQAPGKGLEWVAVISYDGTNKYYTDSVKGRFTISRDNSKDTLYLQMNSLRPEDTAVYYCARDDAVTTSSPSDYYAMDVWGQGTTVTVSS

SEQ ID NO: 3275 - protein, 19 aa, Artificial Sequence
  Synthetic
ARDDAVTTSSPSDYYAMDV

SEQ ID NO: 3276 - protein, 118 aa, Artificial Sequence
  Synthetic
QSVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSKTWGVFGGGTKLTVL

SEQ ID NO: 3277 - protein, 12 aa, Artificial Sequence
  Synthetic
GTWHSNSKTWGV

SEQ ID NO: 3278 - protein, 124 aa, Artificial Sequence
  Synthetic
QVQLQESGPGLVKPSETLSLTCSVSGDSINNFSWNWIRQPPGKGLEWIGYIYYSGSSNYNPSLKSRVTISVDTSKNQFSLKLSSVTAADTAVYYCARGFREPRSFYYDDYYFDYWGQGTQVTVS

SEQ ID NO: 3279 - protein, 19 aa, Artificial Sequence
  Synthetic
ARGFREPRSFYYDDYYFDY

SEQ ID NO: 3280 - protein, 106 aa, Artificial Sequence
  Synthetic
SYVLTQPPSVSVSPGQTARITCSGDAFPNQYAYWYQQKPGQAPVLVIYKDNERPSGIPERFSGSSSGTTVTLTISGVQAEDEADYYCQTADSRGTVFGGGTKVTVL

SEQ ID NO: 3281 - protein, 9 aa, Artificial Sequence
  Synthetic
QTADSRGTV

SEQ ID NO: 3282 - protein, 119 aa, Artificial Sequence
  Synthetic
QVQLVQSGAEVKKPGASVKVSCKASGYTFTSYDINWVRQATGQGLEWVGWMNPNSGNTGYAQKFQGRVTMTRDTSVGTAYMELSSLTSEDTAVYYCARVPTLTYYYDQWGQGTLVTVSS

SEQ ID NO: 3283 - protein, 12 aa, Artificial Sequence
  Synthetic
ARVPTLTYYYDQ

SEQ ID NO: 3284 - protein, 110 aa, Artificial Sequence
  Synthetic
SYVLTQPPSVSVAPGQTARITCGGNNIGSKSVHWYQQKPGQAPVLVVFDDSDRPSGIPERFSGSNSGNTATLTISRVEAGDEADYYCQVWDSTTDRPHVVFGGGTKLTVL

SEQ ID NO: 3285 - protein, 13 aa, Artificial Sequence
  Synthetic
QVWDSTTDRPHVV

SEQ ID NO: 3286 - protein, 128 aa, Artificial Sequence
  Synthetic
QVQLVQSGAEVKKPGSSVKVSCKASGGTFSSYTITWVRQAPGQGLEWMGRIIPILGIAYYAQKFQGRVTITADKSTSTAYMDLSSLRSEDTAVYYCAREGYYDSSESYGLPDYYFDYWGQGTLVTVSS

SEQ ID NO: 3287 - protein, 21 aa, Artificial Sequence
  Synthetic
AREGYYDSSESYGLPDYYFDY

SEQ ID NO: 3288 - protein, 111 aa, Artificial Sequence
  Synthetic
QSVLTQPPSVSGAPGQRVTISCTGSNSNIGAGYDVHWYQQLPGTAPKLLIYGNNNRPSGVPDRFSGSKSGTSASLAITGLQAKDEADYYCQSYDSGLSGSVFGGGTKLTVL

SEQ ID NO: 3289 - protein, 11 aa, Artificial Sequence
  Synthetic
QSYDSGLSGSV

SEQ ID NO: 3290 - protein, 122 aa, Artificial Sequence
  Synthetic
QVQLVESGGGLVKPGGSLRLSCTASGFTFSDYYMSWIRQAPGKGLEWVSYISSSSSTIYYADSVKGRFTISRDNAKNSLYLQMNSLRAEDTAVYYCARAYADWNDLSLFDYWGQGTLVTVSS

SEQ ID NO: 3291 - protein, 15 aa, Artificial Sequence
  Synthetic
ARAYADWNDLSLFDY

SEQ ID NO: 3292 - protein, 109 aa, Artificial Sequence
  Synthetic
QSVLTQPASVSGSPGQSITISCTGTSSDVGSYDLVSWYQQHPGKAPKLMIYEVSKRPSGVSNRFSGSKSGNTASLTISGLQAEDEADYYCCAYAGNTVLFGGGTKLTVL

SEQ ID NO: 3293 - protein, 9 aa, Artificial Sequence
  Synthetic
CAYAGNTVL

SEQ ID NO: 3294 - protein, 127 aa, Artificial Sequence
  Synthetic
EVQLLESGGGLVQPGGSLRLSCAASGFTFSTYAMSWVRQAPGKGLEWVSAISGSGGNTYYADSVKGRFTISRDNSKNTLYLQMNSLRAEDTAVYYCAKVDGSGSPPSYYYYYGMDVWGQGTTVSVSS

SEQ ID NO: 3295 - protein, 20 aa, Artificial Sequence
  Synthetic
AKVDGSGSPPSYYYYYGMDV

SEQ ID NO: 3296 - protein, 108 aa, Artificial Sequence
  Synthetic
SYVLTQPPSVSVAPGQTARISCGGNNIGSKNVHWYQQKPGQAPVLVVYDDSDRPSGIPERFSGSNSGNTATLTISRVEAGDEADYYCQVWDNTSDHVVFGGGTKLTVL

SEQ ID NO: 3297 - protein, 11 aa, Artificial Sequence
  Synthetic
QVWDNTSDHVV

SEQ ID NO: 3298 - protein, 126 aa, Artificial Sequence
  Synthetic
QVQLVESGGGVVQPGRSLRLSCAASGFTFSSYALHWVRQAPGKGLEWVAVISYDGTNKYYTDSVKGRFTISRDNSKNTLYLQMNSLRAEDTAVYYCARDDAVTTSSPSDYYAMDVWGQGTTVTVSS

SEQ ID NO: 3299 - protein, 19 aa, Artificial Sequence
  Synthetic
ARDDAVTTSSPSDYYAMDV

SEQ ID NO: 3300 - protein, 108 aa, Artificial Sequence
  Synthetic
SYVLTQPPSVSVAPGQTARITCGGDNIGSKSVHWYQQKPGQAPVLVVYDDSGRPSGIPERFSGSNSGNTATLTISRVEAGAEADYYCQVWDSSSNQGVFGGGTRLTVL

SEQ ID NO: 3301 - protein, 11 aa, Artificial Sequence
  Synthetic
QVWDSSSNQGV

SEQ ID NO: 3302 - protein, 122 aa, Artificial Sequence
  Synthetic
QVQLVESGGGVVQPGRSLRLSCAASGFTFSSYGMHWVRQAPGKGLEWVAVISNDGSNKYHADSVKGRFTISRDNSKNTLYVQMNSLRAEDTAVYYCAKDVGGRPEKFAFDIWGQGTMVTVSS

SEQ ID NO: 3303 - protein, 15 aa, Artificial Sequence
  Synthetic
AKDVGGRPEKFAFDI

SEQ ID NO: 3304 - protein, 110 aa, Artificial Sequence
  Synthetic
QSVLTQPPSVSGAPGQRVTLSCTGSTSNIGAGYDVHWYQQLPGTAPKLLIYGNTNRPSGVPDRFSGSKSGTSASLAITGLQAEDEADYYCQSYDSSLSGSVFGGGTKLTV

SEQ ID NO: 3305 - protein, 11 aa, Artificial Sequence
  Synthetic
QSYDSSLSGSV

SEQ ID NO: 3306 - protein, 125 aa, Artificial Sequence
  Synthetic
QVQLVQSGAEVKKPGSSVKVSCKASGGTFSSYSISWVRQAPGQGPEWMGRIIPILGIADYAQKFQDRVTITADKSTSTAYMDLSSLRSDDTAVYYCAREEGRPGYCSSTSCYIDWGQGTLVTVSS

SEQ ID NO: 3307 - protein, 18 aa, Artificial Sequence
  Synthetic
AREEGRPGYCSSTSCYID

SEQ ID NO: 3308 - protein, 111 aa, Artificial Sequence
  Synthetic
QSVLTQPPSVSGAPGQRVTISCTGSNSNIGAGYDVHWYQQLPGTAPKLLIYDNNSRPSGVPDRFSGSKSGTSASLAVTGLQAEDEADYYCQSYDSSLSGSVFGGGTKLTVL

SEQ ID NO: 3309 - protein, 11 aa, Artificial Sequence
  Synthetic
QSYDSSLSGSV

SEQ ID NO: 3310 - protein, 122 aa, Artificial Sequence
  Synthetic
QVQLVQSGAEVKKPGASVKVSCKASEYTFTTYYIHWVRQAPGQGLEWMGIINPSAGSITYAQKFQGRVTMTSDTSTSTVYMELSSLRSEDTAVYYCARGGIVPNIYYGMDVWGQGTTVTVSS

SEQ ID NO: 3311 - protein, 15 aa, Artificial Sequence
  Synthetic
ARGGIVPNIYYGMDV

SEQ ID NO: 3312 - protein, 110 aa, Artificial Sequence
  Synthetic
QSVLTQAPSASGTPGQRVTISCSGSSSNIGSKTVNWYQQLPGTAPKLLIYSNNQRPSGVPDRFSGSKSGTSASLAISGLQSEDEADYYCASWDDSVNGGVFGGGTKLTVL

SEQ ID NO: 3313 - protein, 11 aa, Artificial Sequence
  Synthetic
ASWDDSVNGGV

SEQ ID NO: 3314 - protein, 121 aa, Artificial Sequence
  Synthetic
QVQLVQSGAEVKKPGASVKVSCKTSGYTFSNYGISWLRQAPGQGPEWMGWISGYNGDTNYAQKLRGRVTMTTDTSTSTAYMELRSLRSDDTAVYYCARTPGSFRSGYFDYWGQGTLVTVSS

SEQ ID NO: 3315 - protein, 14 aa, Artificial Sequence
  Synthetic
ARTPGSFRSGYFDY

SEQ ID NO: 3316 - protein, 105 aa, Artificial Sequence
  Synthetic
NFMLTQPHSVSESPGKTVTISCTRSSGSIASNYVQWYQQRPGSSPTTVIYEDNQRPSGVPDRFSGSIDSSSNSASLTISGLKTEAEAEDSCQSYDSSSLTKLTVL

SEQ ID NO: 3317 - skipped

SEQ ID NO: 3318 - protein, 126 aa, Artificial Sequence
  Synthetic
EVQLVESGGGLVQPGGSLRLSCAASGFSFSSSWMSWVRQTPGKGLEWVANIKQDGSEKYYVDSVKGRFTISRDNAKNSLYLQMNSVRAEDTAVYFCARGVAIVVVVPTTPEFFDYWGQGTLVTVSS

SEQ ID NO: 3319 - protein, 19 aa, Artificial Sequence
  Synthetic
ARGVAIVVVVPTTPEFFDY

SEQ ID NO: 3320 - protein, 106 aa, Artificial Sequence
  Synthetic
SYVLTQPPSVSVSPGQTARITCSGDALPRQYAYWYQQKPGQAPILVIYKDSERPSGIPERFSGSSSGTTVTLTISGVQAEDEADYYCQSADSSGAVFGGGTQLTVL

SEQ ID NO: 3321 - protein, 9 aa, Artificial Sequence
  Synthetic
QSADSSGAV

SEQ ID NO: 3322 - protein, 128 aa, Artificial Sequence
  Synthetic
QVQLVESGGGLVKPGGSLRLSCAASGFTFSDYYMTWIRQAPGKGLEWVAYISSNGRTIYYADSVKGRFTISRDNAKNLLYLQMNSLRAEDTAVFYCAKGYCGDDCYPLVSEDWYFDLWGHGTLVTVSS

SEQ ID NO: 3323 - protein, 21 aa, Artificial Sequence
  Synthetic
AKGYCGDDCYPLVSEDWYFDL

SEQ ID NO: 3324 - protein, 110 aa, Artificial Sequence
  Synthetic
QSVLTQPASVSGSPGQSLTISCTGTSSDVGGYNYVSWYQQHPGKAPKLMIYEVSNRPSGVSNRFSGSKSGNTASLTISGLQPEDEADYYCCSCTTSNTLVFGTGTKVTVL

SEQ ID NO: 3325 - protein, 10 aa, Artificial Sequence
  Synthetic
CSCTTSNTLV

SEQ ID NO: 3326 - protein, 124 aa, Artificial Sequence
  Synthetic
QVQLVQSGAEVKKPGSSVKVSCKASGGTFSSNTISWVRQAPGQGLEWMGRIIPILGIPNHAQKFQGRVTITADKSTSTAYMELSSLRSEDTAVYYCAREGDYSDYGATWYFDLWGRGTLVTVSS

SEQ ID NO: 3327 - protein, 17 aa, Artificial Sequence
  Synthetic
AREGDYSDYGATWYFDL

SEQ ID NO: 3328 - protein, 111 aa, Artificial Sequence
  Synthetic
QSVLTQPPSVSGAPGQRVTISCTGSNSNIGAGYDVHWYQQLPGTAPKLLIYRNTNRPSGVPDRFSGSKSDTSASLVITGLQAEDEADYYCQSYDSSLSGSVFGGGTKLTVL

SEQ ID NO: 3329 - protein, 11 aa, Artificial Sequence
  Synthetic
QSYDSSLSGSV

SEQ ID NO: 3330 - protein, 125 aa, Artificial Sequence
  Synthetic
QVQLVQSGAEVKKPGSSVKVSCKASGGTFSSYTITWVRQAPGQGLEWMGRIIPILGIADYAEKFQDRVTITADKSTSTAYMELSSLTSDDTALYYCARDEGRPGYCSSTGCYIDWGQGTLVTVSS

SEQ ID NO: 3331 - protein, 18 aa, Artificial Sequence
  Synthetic
ARDEGRPGYCSSTGCYID

SEQ ID NO: 3332 - protein, 111 aa, Artificial Sequence
  Synthetic
QSVLTQPPSVSGAPGQRVTISCTGSNSNIGAGYDVHWYQQLPGIAPKLLIYDNTNRPSGVPDRFSGSKSGTSASLAITGLQAEDEAVYYCQSYDSSLSGSVFGGGTRLTVL

SEQ ID NO: 3333 - protein, 11 aa, Artificial Sequence
  Synthetic
QSYDSSLSGSV

SEQ ID NO: 3334 - protein, 126 aa, Artificial Sequence
  Synthetic
EVQLVESGGGLVQPGRSLRLSCAASGFTFDDYAIHWVRQPPGKGLEWVSGITWNGGTIGYADSVKGRFTISRDNAKNSLYLQMNRLRVEDTALYYCAKDYARIPVGREEDYYFDYWGRGTLVTVSS

SEQ ID NO: 3335 - protein, 19 aa, Artificial Sequence
  Synthetic
AKDYARIPVGREEDYYFDY

SEQ ID NO: 3336 - protein, 108 aa, Artificial Sequence
  Synthetic
SYVLTQPPSVSVAPGQTARITCGGNNIESKTVHWYQQKPGQAPVLVVYDNSDRPSGIPERFSGSNSGNTATLTISRVEAGDEADYYCQVWDSRTDRVVFGGGTKLTVL

SEQ ID NO: 3337 - protein, 11 aa, Artificial Sequence
  Synthetic
QVWDSRTDRVV

SEQ ID NO: 3338 - protein, 119 aa, Artificial Sequence
  Synthetic
QVQLVQSGAEVKKPGASVKVSCKASGYTFTNYDINWVRQAAGQGLEWMGWMNPNSGSTGYAQKFQGRVTMTRNTSISTAYMELSSLRSEDTAVYYCARGGALTGYVDYWGQGTLVTVSS

SEQ ID NO: 3339 - protein, 12 aa, Artificial Sequence
  Synthetic
ARGGALTGYVDY

SEQ ID NO: 3340 - protein, 109 aa, Artificial Sequence
  Synthetic
SYVLTQPPSVSVAPGQTARITCGGNNIGSKNVHWYQQKPGQAPVLVVFDDSDRPSGIPERFSGSNSGNTATLTISRVEAGDEADYYCQLWDSTGDPLYVFGTGTKVTVL

SEQ ID NO: 3341 - protein, 12 aa, Artificial Sequence
  Synthetic
QLWDSTGDPLYV

SEQ ID NO: 3342 - protein, 130 aa, Artificial Sequence
  Synthetic
EVQLVESGGGLVQPGRSLRLSCAASGFTFDDYAMHWVRQAPGKGLEWVSGVSWNSGTIGYADSVKGRFTISRDNAKNSLYLQMNSLRAEDTAFYYCAKSGPRDSSVYYYDTGVKYYFDYWGQGTLVTVSS

SEQ ID NO: 3343 - protein, 23 aa, Artificial Sequence
  Synthetic
AKSGPRDSSVYYYDTGVKYYFDY

SEQ ID NO: 3344 - protein, 106 aa, Artificial Sequence
  Synthetic
SYVLTQPPSVSVAPGQTARITCAGNNIGSQSVHWYQQKPGQAPVLVVYDDSDRPSGIPERFSGSNSGNTATLTISRVEAGDEADYYCQVWDTSSDDAVFGGGTQLT

SEQ ID NO: 3345 - protein, 11 aa, Artificial Sequence
  Synthetic
QVWDTSSDDAV

SEQ ID NO: 3346 - protein, 125 aa, Artificial Sequence
  Synthetic
EVQLVQSGAEVKKPGESLKISCKGSGYSFTNHWIGWVRQMPGKGLEWMGIIYPYDSDTTYSPSFQGQVTISADKSISTVYLQWSSLKASDTAMYYCARHDGALSQLELFNGMDVWGQGTTVTVSS

SEQ ID NO: 3347 - protein, 18 aa, Artificial Sequence
  Synthetic
ARHDGALSQLELFNGMDV

SEQ ID NO: 3348 - protein, 110 aa, Artificial Sequence
  Synthetic
QSVLTQPPSVSAAPGQKVTISCSGSSSNIGNNYVSWYQQLPGTAPKLLIYDSNKRPSGIPDRFSGSKSGTSATLGITGLQTGDEADYYCGTWDSSLSVVVFGGGTKLTVL

SEQ ID NO: 3349 - protein, 11 aa, Artificial Sequence
  Synthetic
GTWDSSLSVVV

SEQ ID NO: 3350 - protein, 129 aa, Artificial Sequence
  Synthetic
EVQLVESGGGLVQPGRSLRLSCAVSGFTFEDYGMHWVRQGPGKGLEWVSGISWNGGTIGYADSVKGRFIISRDNAKNSLYLHMNSLRVEDTALYYCAKDKGYYYDSSGYYRDLYYSDYWGQGTLVTVSS

SEQ ID NO: 3351 - protein, 22 aa, Artificial Sequence
  Synthetic
AKDKGYYYDSSGYYRDLYYSDY

SEQ ID NO: 3352 - protein, 108 aa, Artificial Sequence
  Synthetic
SYVLTQSPSVSVAPGQTARITCGGNNIGSKSVHWYQQKPGQAPVLVVYDDSDRPSGIPERFSGSNSGNTATLTISRVEAGDEADYYCQVWDSSSDLVVFGGGTKLTVL

SEQ ID NO: 3353 - protein, 11 aa, Artificial Sequence
  Synthetic
QVWDSSSDLVV

SEQ ID NO: 3354 - protein, 127 aa, Artificial Sequence
  Synthetic
QVQLVQSGAEVKKPGSSVKVSCKASGGTFSSYAINWVRQAPGQGLEWMGGIIPIFGTANYAQKFQDRVTITADKSTSTAYMELSSLRSEDTAVYYCARMQLEDTYGYTRYYYHDMDVWGQGTTVTVS

SEQ ID NO: 3355 - protein, 21 aa, Artificial Sequence
  Synthetic
ARMQLEDTYGYTRYYYHDMDV

SEQ ID NO: 3356 - protein, 112 aa, Artificial Sequence
  Synthetic
QSVLTQPPSVSGAPGQRVTISCTGSSSNIGAGYDVHWYQQLPGTAPKLLIYDNTNRPSGVPDRFSGSKSGTSASLAITGLQAEDAADYYCQSYDSSLSGDVVFGGGTKLTVL

SEQ ID NO: 3357 - protein, 12 aa, Artificial Sequence
  Synthetic
QSYDSSLSGDVV

SEQ ID NO: 3358 - protein, 130 aa, Artificial Sequence
  Synthetic
EVQLVESGGGLVQPGRSLRLSCAASGFTFDDYDMHWVRQAPGKGLEWVSGISWNSGTIGYADSVKGRFTISRDNAKNSLYLQMNSLRAEDTALYYCAKDLATKSSGYFWESGGTYYFDNWGQGTLVTVSS

SEQ ID NO: 3359 - protein, 23 aa, Artificial Sequence
  Synthetic
AKDLATKSSGYFWESGGTYYFDN

SEQ ID NO: 3360 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 3361 - protein, 11 aa, Artificial Sequence
  Synthetic
QVWDSSSDHVV

SEQ ID NO: 3362 - protein, 124 aa, Artificial Sequence
  Synthetic
QVQLVQSGAEVRKPGSSVKVSCKASGGTFSSYIISWVRQAPGQGLEWMGNIIPILGIPNYAQKFQGRVTITADKSTSTAYMELSSLRSEDTALYYCARALGITSGGANYAFDIWGQGTMVTVSS

SEQ ID NO: 3363 - protein, 17 aa, Artificial Sequence
  Synthetic
ARALGITSGGANYAFDI

SEQ ID NO: 3364 - protein, 111 aa, Artificial Sequence
  Synthetic
QSVLTQPPSVSGAPGQRVTISCTGSSSNIGAGYDVHWYQQLSGTAPKLLIYANNNRPSGVPDRFSGSNSGTSASLAITGLQAEDEADYYCQSYDSSLSDSVFGGGTKVTVL

SEQ ID NO: 3365 - protein, 11 aa, Artificial Sequence
  Synthetic
QSYDSSLSDSV

SEQ ID NO: 3366 - protein, 128 aa, Artificial Sequence
  Synthetic
QVQLVQSGAEVKKPGSSVKVSCKASGGTFSTYAISWVRQAPGQGLEWMGGIIPMFGTANYAQKFQGRVKISADESTSTAYMELSSLRSEDTAVYYCARAANRVFGSGSYYENNWFDPWGQGTLVTVSS

SEQ ID NO: 3367 - protein, 21 aa, Artificial Sequence
  Synthetic
ARAANRVFGSGSYYENNWFDP

SEQ ID NO: 3368 - protein, 105 aa, Artificial Sequence
  Synthetic
SYVLTQPPSVSVSPGQTASITCSGDKLGDKYAYWYQQKPGQSPVLVIYQDNKRPSGIPERFSGSNSGNTATLTISGTQAMDEADYYCQAWDSSTVFGTGTKVTVL

SEQ ID NO: 3369 - protein, 8 aa, Artificial Sequence
  Synthetic
QAWDSSTV

SEQ ID NO: 3370 - protein, 127 aa, Artificial Sequence
  Synthetic
QVQLVQSGAEVKKPGSSVKVSCKASGGTFSNYAITWVRQAPGQGLEWMGGIIPMSGAANYAQKFQGRVTITADNSTSTAYMELSSLRSEDTALYYCAKDLTHMIRGQNYYYYAMAVWGQGTTVSVSS

SEQ ID NO: 3371 - protein, 20 aa, Artificial Sequence
  Synthetic
AKDLTHMIRGQNYYYYAMAV

SEQ ID NO: 3372 - protein, 110 aa, Artificial Sequence; identical to SEQ ID NO: 2796
  Synthetic

SEQ ID NO: 3373 - protein, 11 aa, Artificial Sequence
  Synthetic
AAWDDSLNGVV

SEQ ID NO: 3374 - protein, 118 aa, Artificial Sequence
  Synthetic
EVQLVESGGGLVQPGGSLRLSCAASEITVSSNYMSWVRQAPGKGLEWVSLLYSGGSTYYADSVKGRFTISRDSSKNTLYLQMNSLRPEDTAVYYCARDLMEVGGMDVWGQGTTVTVSS

SEQ ID NO: 3375 - protein, 12 aa, Artificial Sequence
  Synthetic
ARDLMEVGGMDV

SEQ ID NO: 3376 - protein, 110 aa, Artificial Sequence
  Synthetic
QSVLTQPPSASGTPGQRVTISCSGSSSNIGSDYVYWYQHLPGTAPKLLIYRINQRPSGVPDRFSGSKSGTSASLAISGLRSEDEADYYCAAWDDSLSGYVFGTGTKVTVL

SEQ ID NO: 3377 - protein, 10 aa, Artificial Sequence
  Synthetic
AAWDDSSGYV

SEQ ID NO: 3378 - protein, 125 aa, Artificial Sequence
  Synthetic
EVQLVESGGGLVQPGRSLRLSCAASGFTFEDYAMHWVRQAPGKGLEWVSGITWNSGIIGYADSVKGRFTISRDNAKNSLYLQMNSLRAEDTALYYCAKDRTPYGARPEDYDMDVWGQGTTVTVSS

SEQ ID NO: 3379 - protein, 18 aa, Artificial Sequence
  Synthetic
AKDRTPYGARPEDYDMDV

SEQ ID NO: 3380 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSGTDHVVFGGGTKLTVL

SEQ ID NO: 3381 - protein, 11 aa, Artificial Sequence
  Synthetic
QVWDSGTDHVV

SEQ ID NO: 3382 - protein, 121 aa, Artificial Sequence
  Synthetic
EVQLVESGGGLVQPGRSLRLSCAASGFTFDDYAMFWVRQAPGKGLEWVSGISWNSGDIGYADSVKGRFTISRDNAKNSLYLQMNSLRGEDTAFYFCAKSSLGELPFTIDNWGQGTLVTVSS

SEQ ID NO: 3383 - protein, 14 aa, Artificial Sequence
  Synthetic
AKSSLGELPFTIDN

SEQ ID NO: 3384 - protein, 111 aa, Artificial Sequence
  Synthetic
QSVLTQSSSASASLGSSVKLTCTLSSGYSSYIIAWHQQQPGKAPRYLMKLEGSGSYNKGSGVPDRFSGSSSGADRYLTISSLQSEDEADYYCETWDIDTHVFGTGTKVTVL

SEQ ID NO: 3385 - protein, 9 aa, Artificial Sequence
  Synthetic
ETWDIDTHV

SEQ ID NO: 3386 - protein, 127 aa, Artificial Sequence
  Synthetic
QLQLQESGSGLVKPSQTLSLTCAVSGGSFSSGGDSWTWIRQPPGKGLECIGYIYHSGSTYYNPSLKSRVTISVDRSKNQFSLNLSSVTAADTAVYYRARDYPGSGSSTPFYCTMDVWGQGTTVTVSS

SEQ ID NO: 3387 - protein, 19 aa, Artificial Sequence
  Synthetic
ARDYPGSGSSTPFYCTMDV

SEQ ID NO: 3388 - protein, 111 aa, Artificial Sequence
  Synthetic
QSVLTQPPSVSGAPGQRVTMSCTGSNSNIGAGYDVHWYQHLPGTAPKLLIYDNSNRPSGVPDRFSGSKSGTSASLAITGLQAEDEADYYCQSYDSSLSGSVFGGGTKLTVL

SEQ ID NO: 3389 - protein, 11 aa, Artificial Sequence
  Synthetic
QSYDSSLSGSV

SEQ ID NO: 3390 - protein, 129 aa, Artificial Sequence
  Synthetic
QLQLQESGPGLVKPSETLSLTCTVSGDSISSRSYYWGWIRQPPGKGLEWIGIIYYGGSTSYNPSLKSRVTISVDTSKNHFSLKLTSVTAADTAVYYCARVKDYYDSSGYSHSDCYFDLWGRGTLVTVSS

SEQ ID NO: 3391 - protein, 21 aa, Artificial Sequence
  Synthetic
ARVKDYYDSSGYSHSDCYFDL

SEQ ID NO: 3392 - protein, 113 aa, Artificial Sequence
  Synthetic
QSVLTQPASVSGAPGQRVTISCTGSSSNIGAGYDVHWYQQLPGTAPKLLIYGNTNRPSGVPDRFSGSKSGTSASLAITGLQAEDEADYYCQSYDSSLSGPNYVFGTGTKVTVL

SEQ ID NO: 3393 - protein, 13 aa, Artificial Sequence
  Synthetic
QSYDSSLSGPNYV

SEQ ID NO: 3394 - protein, 126 aa, Artificial Sequence
  Synthetic
EVQLVESGGGLVQPGRSLRLSCAASGFTFDDYAMHWVRQAPGKGLEWVSGISWNSVSIGYADSVKGRFTISRDNAKNSLYLQMNSLRPEDTAFYYCARGDYCTNTRCYTWSWFDPWGQGTLVTVSS

SEQ ID NO: 3395 - protein, 19 aa, Artificial Sequence
  Synthetic
ARGDYCTNTRCYTWSWFDP

SEQ ID NO: 3396 - protein, 109 aa, Artificial Sequence
  Synthetic
SYVLTQPPSVSVAPGQTARITCGGDNIGSKSVHWYQQKSGQAPVLVVYDDSDRPSGIPERFSGSNSGNTATLTLSRVEAGDEADYYCQVWGSTSDHPYVFGTGTKVTVL

SEQ ID NO: 3397 - protein, 12 aa, Artificial Sequence
  Synthetic
QVWGSTSDHPYV

SEQ ID NO: 3398 - protein, 121 aa, Artificial Sequence
  Synthetic
QVQLQESGPGLVKPSGTLSLTCVVSGGSISSRNWWSWVRQPPGKGLEWIGEIYHNANTNYNPSLKSRVTISVDKSKNQFSLKLSSVTAADTAIYYCARERGGGPHDGFDIWGQGTMVTVSS

SEQ ID NO: 3399 - protein, 14 aa, Artificial Sequence
  Synthetic
ARERGGGPHDGFDI

SEQ ID NO: 3400 - protein, 110 aa, Artificial Sequence; identical to SEQ ID NO: 1316
  Synthetic

SEQ ID NO: 3401 - protein, 10 aa, Artificial Sequence
  Synthetic
SSYTSSSTVV

SEQ ID NO: 3402 - protein, 124 aa, Artificial Sequence
  Synthetic
QVQLVQSGAEVKKPGSSVKVSCKASGGTFSSYTISWVRQAPGQGLEWMGRIIPILNIANYAQRFQGRVTITADKSTSTAYMELSGLRSEDTAVYYCAREGDYSDFGATWYFALWGRGTLVTVSS

SEQ ID NO: 3403 - protein, 17 aa, Artificial Sequence
  Synthetic
AREGDYSDFGATWYFAL

SEQ ID NO: 3404 - protein, 111 aa, Artificial Sequence
  Synthetic
QSVLTQPPSVSGAPGQRVTISCTGSNSNIGAGYDVHWYQQLPGTAPKLLIYSNSNRPSGVPDRFSGSKSGTSASLAITGLQAEDEADYYCQSYDSSLSDSVFGGGTKLTVL

SEQ ID NO: 3405 - protein, 11 aa, Artificial Sequence
  Synthetic
QSYDSSLSDSV

SEQ ID NO: 3406 - protein, 128 aa, Artificial Sequence
  Synthetic
EVQLVESGGGLVQPGGSLRLSCAASGFTVSSNYMSWVRQAPGKGLEWVSVIYSGDSTFYADSVRGRFTISRDNSKNTLYLQMNSLRVEDTAVYYCARLAGILNIPTMGSTEGGFFDYWGQGTLVTVSS

SEQ ID NO: 3407 - protein, 22 aa, Artificial Sequence
  Synthetic
ARLAGILNIPTMGSTEGGFFDY

SEQ ID NO: 3408 - protein, 110 aa, Artificial Sequence
  Synthetic
QSVLTQPASVSGSPGQSITISCTGTSSDVGTYNLVSWYQQHPGKAPKLMIYELSKRPSGVSNRFSGSKSGNTASLTISGLQAEDEADYYCCSYAGSHTWVFGGGTKLTVL

SEQ ID NO: 3409 - protein, 10 aa, Artificial Sequence
  Synthetic
CSYAGSHTWV

SEQ ID NO: 3410 - protein, 126 aa, Artificial Sequence
  Synthetic
EVQLVESGGGLVQPGRSLRLSCAASGFTFDDYAMHWVRQAPGKGLEWVSGISWNSGTIGYADSVKGRFTISRDNAKNSLFLHMRSLRGEDTAFYYCAKDTAVMTLVRGEAYGMDVWGQGTTVTVSS

SEQ ID NO: 3411 - protein, 19 aa, Artificial Sequence
  Synthetic
AKDTAVMTLVRGEAYGMDV

SEQ ID NO: 3412 - protein, 110 aa, Artificial Sequence
  Synthetic
QSVLTQPASVSGSPGQSITISCTGTSSDVGGYNYVSWYRQHPGEAPKLMIYEVSNRPSGVSNRFSGSKSGNTASLTISGLQAEDEADYYCSSYTTISTVVFGGGTKLTVL

SEQ ID NO: 3413 - protein, 10 aa, Artificial Sequence
  Synthetic
SSYTTISTVV

SEQ ID NO: 3414 - protein, 125 aa, Artificial Sequence
  Synthetic
QVQLVQSGAEVKKPGSSVKVSCRASGGTFSSYSISWVRQAPGQGLEWMGRIIPILGIADYAQKFQGRVTITADKSTGTAYMELSSLRSEDTAVYYCATDKANNGSSGATWWFDPWGQGTLVTVSS

SEQ ID NO: 3415 - protein, 18 aa, Artificial Sequence
  Synthetic
ATDKANNGSSGATWWFDP

SEQ ID NO: 3416 - protein, 111 aa, Artificial Sequence
  Synthetic
QSVLTQPPSLSGAPGQRVTISCTGSGSNIGAGYDVHWYQQFLGTAPKLLIYGNINRPSGVPDRFSGSKSGTSASLAITGLQAEDEADYYCQSYDSSLSGSVFGGGTSLTVL

SEQ ID NO: 3417 - protein, 11 aa, Artificial Sequence
  Synthetic
QSYDSSLSGSV

SEQ ID NO: 3418 - protein, 122 aa, Artificial Sequence
  Synthetic
EVQLVESGGGLVQPGGSLRLSCAASGFTFRNYAMNWVRQAPGKGLEWVSYISPSSITIYYADSVKGRFTISRDNAENSLYLQMNSLRDEDTAVYYCARPSPEKYQADVFDIWGQGTMVTVSS

SEQ ID NO: 3419 - protein, 15 aa, Artificial Sequence
  Synthetic
ARPSPEKYQADVFDI

SEQ ID NO: 3420 - protein, 114 aa, Artificial Sequence
  Synthetic
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTLPLTFGGGTKVEIK

SEQ ID NO: 3421 - protein, 10 aa, Artificial Sequence
  Synthetic
QQYYSTLPLT

SEQ ID NO: 3422 - protein, 117 aa, Artificial Sequence
  Synthetic
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCGRDRYSRSMDVWGQGTTVTVSS

SEQ ID NO: 3423 - DNA, 11 bp, Artificial Sequence
  Synthetic
grdrysrsmdv

SEQ ID NO: 3424 - protein, 107 aa, Artificial Sequence
  Synthetic
DIQMTQSPSSLSASVGDRVTITCQASQDIRNYLNWYQQKPGKAPKLLIYDASNLETGVPSRFSGSGSGTDFTFTISSLQPEDIATYYCQQSDNLPPAFGGGTKVEIK

SEQ ID NO: 3425 - protein, 9 aa, Artificial Sequence
  Synthetic
QQSDNLPPA

SEQ ID NO: 3426 - protein, 121 aa, Artificial Sequence
  Synthetic
EVQLVESGGGLVQPGGSLRLSCAASGFTFSSYDMHWVRQATGKGLEWVSVIGTAGDTYYPDSVKGRFTISRENAKNSLYLQINSLRAGDTAVYYCARDRGSSWYPAAFDVWGQGTMVTVSS

SEQ ID NO: 3427 - protein, 15 aa, Artificial Sequence
  Synthetic
ARDRGSSWYPAAFDV

SEQ ID NO: 3428 - protein, 108 aa, Artificial Sequence
  Synthetic
DIQMTQSPSSLPASVGDRVTITCRASQSISSYLNWYQQKPGKAPKLLIYAASSLQSGVPSRFSGSGSGTEFTLTISSLQPEDFATYYCQQSYSSPTYTFGQGTKLEIK

SEQ ID NO: 3429 - protein, 10 aa, Artificial Sequence
  Synthetic
QQSYSSPTYT

SEQ ID NO: 3430 - protein, 117 aa, Artificial Sequence
  Synthetic
EVQLVESGGGLIQPGGSLRLSCAASGFTVSSNYMSWVRQAPGKGLEWVSVIYSGGSTFYADSVKGRFTISRDNSKNTLYFQMNSLRADDTAVYYCARDVFEGAFDIWGQGTMVTVSS

SEQ ID NO: 3431 - protein, 11 aa, Artificial Sequence
  Synthetic
ARDVFEGAFDI

SEQ ID NO: 3432 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPLVTFGGGTKVEIK

SEQ ID NO: 3433 - protein, 10 aa, Artificial Sequence
  Synthetic
QQLNSYPLVT

SEQ ID NO: 3434 - protein, 123 aa, Artificial Sequence
  Synthetic
QVQLVESGGGVVQPGRSLRLSCAASAFTLSSFGVHWVRQAPGQGLEWVTFISYDGSDKYYADSVKGRFTISRDNSKNTVYLQMNSLRGEDTAVYYCAKDLYPALAYYYGMDVWGQGTTVTVSS

SEQ ID NO: 3435 - protein, 16 aa, Artificial Sequence
  Synthetic
AKDLYPALAYYYGMDV

SEQ ID NO: 3436 - protein, 107 aa, Artificial Sequence; identical to SEQ ID NO: 1020
  Synthetic

SEQ ID NO: 3437 - protein, 9 aa, Artificial Sequence
  Synthetic
QQRSNWPLT

SEQ ID NO: 3438 - protein, 122 aa, Artificial Sequence
  Synthetic
QVQLVQSGAEVKKPGASVKVSCKASGYTFTNYYMHWVRQAPGQGLEWMGIINPSAGSTTYAQKFQGRVTMTRDTSTSTVYMELSNLRSEDTAVYYCARDFGLIPDSNYFDCWGQGTLVTVSS

SEQ ID NO: 3439 - protein, 15 aa, Artificial Sequence
  Synthetic
ARDFGLIPDSNYFDC

SEQ ID NO: 3440 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSSRTFGQGTKLEIK

SEQ ID NO: 3441 - protein, 9 aa, Artificial Sequence
  Synthetic
QQYGSSSRT

SEQ ID NO: 3442 - protein, 118 aa, Artificial Sequence
  Synthetic
EVQLVESGGGLIQPGGSLRLSCAASGLTVSRNYMSWVRQAPGKGLEWVSVIYSGGSTFYADSVKGRFTISRDNSKNTLYLQMNSLSAEDTAVYYCARDLDTAGGMDVWGQGTTVTVSS

SEQ ID NO: 3443 - protein, 12 aa, Artificial Sequence
  Synthetic
ARDLDTAGGMDV

SEQ ID NO: 3444 - protein, 107 aa, Artificial Sequence
  Synthetic
DIQLTQSPSFLSASVGDRVTITCRASQGISSNLAWYQQKPGKAPKLLIYVASTLQSGVPSRFSGSGSGTEFTLTISSLQPEDFATYYCQQLSSYPSTFGQGTKVEIK

SEQ ID NO: 3445 - protein, 9 aa, Artificial Sequence
  Synthetic
QQLSSYPST

SEQ ID NO: 3446 - protein, 118 aa, Artificial Sequence
  Synthetic
EVQLVESGGGLIQPGGSLRLSCAASGITVSRNYMNWVRQAPGKGLEWISVIYSGGTTYYAGSVKGRFTISRDNSKNTLYLQMNSLRAEDTAVYYCARDLDTAGGMDVWGQGTTVTVSS

SEQ ID NO: 3447 - protein, 12 aa, Artificial Sequence
  Synthetic
ARDLDTAGGMDV

SEQ ID NO: 3448 - protein, 110 aa, Artificial Sequence
  Synthetic
DIQLTQSPSFLSASVGDRVTITCRASQGISNYLAWYQQKPGKAPKVLIYAASTLQSGVPSRFSGSGSGTEFTLTISSLQPEDFATYYCQQLNSYPSYPWTFGQGTKVEIK

SEQ ID NO: 3449 - protein, 12 aa, Artificial Sequence
  Synthetic
QQLNSYPSYPWT

SEQ ID NO: 3450 - protein, 119 aa, Artificial Sequence
  Synthetic
EVQLVESGGDLVQPGGSLRLSCAASGFTVSSNYINWVRQAPGKGLEWVSVLYSGGSAFYADSVKGRFTISRDNSKNTLYLQMDSLRADDTAVYFCARFGGYARGDMDVWGQGTTVTVSS

SEQ ID NO: 3451 - protein, 13 aa, Artificial Sequence
  Synthetic
ARFGGYARGDMDV

SEQ ID NO: 3452 - protein, 107 aa, Artificial Sequence
  Synthetic
DIQMTQSPSSLSASVGDRVTITCQASQDINNYLNWYQQKPGKAPKLLIYDASNLETGVPSRFSGNGSGTDFTFTISSLQPEDIATYYCQQYDNLPITFGGGTKVEIK

SEQ ID NO: 3453 - protein, 9 aa, Artificial Sequence
  Synthetic
QQYDNLPIT

SEQ ID NO: 3454 - protein, 124 aa, Artificial Sequence
  Synthetic
EVQLVESGGGLVKPGGSLRLSCEASGFNLSRHTMNWVRQAPGKGLEWVSSISPSSTYIYYADPVKGRFTISRDNAKNSLYLQMNSLRAEDTALYYCARDLSAIPTILPYGMDVWGQGTTVTVSS

SEQ ID NO: 3455 - protein, 17 aa, Artificial Sequence
  Synthetic
ARDLSAIPTILPYGMDV

SEQ ID NO: 3456 - protein, 103 aa, Artificial Sequence
  Synthetic
DIQLTQSPSFLSASVGDRVTITCRASQAISDYLAWYQQKPGKAPKLLIYGASTLQSGVPSRFSGSGSGTEFTLTISSLQPEDFATYYCQQPRTFGQGTKLEIK

SEQ ID NO: 3457 - protein, 5 aa, Artificial Sequence
  Synthetic
QQPRT

SEQ ID NO: 3458 - protein, 124 aa, Artificial Sequence
  Synthetic
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDPLPSRYYYDSSGYTYWGQGTLVTVSS

SEQ ID NO: 3459 - protein, 18 aa, Artificial Sequence
  Synthetic
ARDPLPSRYYYDSSGYTY

SEQ ID NO: 3460 - protein, 104 aa, Artificial Sequence
  Synthetic
DIQMTQSLSASVGDRVTITCQASQDISNYLNWYQQKPGKAPKLLIYDASNLETGVPSRFSGSGSGTDFTFTISSLQPEDIATYYCQQYDNLPQTFGQGTKLEIK

SEQ ID NO: 3461 - protein, 9 aa, Artificial Sequence
  Synthetic
QQYDNLPQT

SEQ ID NO: 3462 - protein, 123 aa, Artificial Sequence
  Synthetic
QVQLVESGGGLVKPGGSLRLSCAASGFSFSDYHLTWIRQAPGKGLEWVSSISRSGSTIYYADSVEGRFTISRDNAKNSLYLQMNSLRAEDTAVYYCARDRRGYFDWLSNLDYWGQGTLVTVSS

SEQ ID NO: 3463 - protein, 16 aa, Artificial Sequence
  Synthetic
ARDRRGYFDWLSNLDY

SEQ ID NO: 3464 - protein, 112 aa, Artificial Sequence
  Synthetic
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGVHWPPTFGQGTRLEIK

SEQ ID NO: 3465 - protein, 9 aa, Artificial Sequence
  Synthetic
MQGVHWPPT

SEQ ID NO: 3466 - protein, 122 aa, Artificial Sequence
  Synthetic
QVQLVQSGAEVKKPGASLKISCKASGDTFTTYYIHWVRQAPGQGLEWMGIMNPSGGSTSYAQKFRGRIAMTSDTSTSTVYMELSSLTSEDTAVYYCARGGLVPDAAEPFDYWGQGTLVTVSS

SEQ ID NO: 3467 - protein, 15 aa, Artificial Sequence
  Synthetic
ARGGLVPDAAEPFDY

SEQ ID NO: 3468 - protein, 107 aa, Artificial Sequence
  Synthetic
DIQMTQSPSTLSASVGDRVTITCRASQSISNWLAWYQQKPGKAPKLLIYKASTLESGVPSRFSGSGSGTEFTLTISSLQPDDFATYYCQHYNSYLWTFGQGTKVEIK

SEQ ID NO: 3469 - protein, 9 aa, Artificial Sequence
  Synthetic
QHYNSYLWT

SEQ ID NO: 3470 - protein, 125 aa, Artificial Sequence
  Synthetic
EVQLVQSGAEVKKPGESLKISCKGSGDSFTSYWIGWVRQRPGKGLEWMGIIYPGDSDTRYSPSFEGHVTISADKSISTAFLQWSSLKASDSAMYYCASLGGYGSGRGAEMPFDPWGQGTLVTVSS

SEQ ID NO: 3471 - protein, 18 aa, Artificial Sequence
  Synthetic
ASLGGYGSGRGAEMPFDP

SEQ ID NO: 3472 - protein, 108 aa, Artificial Sequence
  Synthetic
EIVLTQSPGTLSLSPGERATLSCRASQSVSSSYLGWYQQKPGQAPRLLIYGATSRATGIPDRFSGSGSGTDFTLTISRLEPEDFAVYYCQQYDSSPFTFGPGTTVDIK

SEQ ID NO: 3473 - protein, 9 aa, Artificial Sequence
  Synthetic
QQYDSSPFT

SEQ ID NO: 3474 - protein, 121 aa, Artificial Sequence
  Synthetic
QMQLVQSGPEVKKPGTSVKVSCKASGFTFTSSAMQWVRQARGQRLEWIGCIVVGSGNTNYAQKFQERVTITRDMSTSTAYMELSSLRSEDTAVYYCAADRGDSSGWYFDYWGQGTLVTVSS

SEQ ID NO: 3475 - protein, 14 aa, Artificial Sequence
  Synthetic
AADRGDSSGWYFDY

SEQ ID NO: 3476 - protein, 105 aa, Artificial Sequence
  Synthetic
EIVLTQSPGTLSLSPGERATLSCRASQSVSSSYLVWYQQKPGQAPRLLIYGASSRATGIPDRFSGSGSGTDFTLTISRLEPEDFAMYYCQHYGSPIGPGTKVDIK

SEQ ID NO: 3477 - protein, 6 aa, Artificial Sequence
  Synthetic
QHYGSP

SEQ ID NO: 3478 - protein, 121 aa, Artificial Sequence
  Synthetic
QVQLQESGPGLVKPSQTLSLTCTVSGDSITSGSYYWSWIRQPAGKGLEWIGRIYPSGSTDYNPSLKSRVTISMDTSKNQFSLKLTSVTAADTAVYYCARAGDYLGIVGGYWGQGTLVTVSS

SEQ ID NO: 3479 - protein, 13 aa, Artificial Sequence
  Synthetic
ARAGDYLGIVGGY

SEQ ID NO: 3480 - protein, 107 aa, Artificial Sequence
  Synthetic
DIQMTQSPSSLSASVGDRVTITCQASQDIRNFLNWYQQKPGKAPKLLIYDASNLETGVASRFSGSGSGTDFTLTISSLQPEDIARYFCQQYNNLPFTFGPGTKVDIK

SEQ ID NO: 3481 - protein, 9 aa, Artificial Sequence
  Synthetic
QQYNNLPFT

SEQ ID NO: 3482 - protein, 133 aa, Artificial Sequence
  Synthetic
EVQLLESGGGLVQPGGSLRLSCAASGFTFSRYAMSWVRQAPGKGLECVSTISGSGGSTYHADSVKGRFTISRDNSKNTLYLQMNSLRAEDTAVYYCAKDQVPYYYDSSGYYGSFDLLDYFDDWGQGTLVTVSS

SEQ ID NO: 3483 - protein, 26 aa, Artificial Sequence
  Synthetic
AKDQVPYYYDSSGYYGSFDLLDYFDD

SEQ ID NO: 3484 - protein, 107 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKLEIK

SEQ ID NO: 3485 - protein, 9 aa, Artificial Sequence
  Synthetic
QQYNSYSRT

SEQ ID NO: 3486 - protein, 127 aa, Artificial Sequence
  Synthetic
QVQLVQSGAEVKKPGASVKVSCKASGYTFTSYDINWVRQATGQGLEWMGWMNPNSGNTGYAQRFQGRVTMTRNTSISTAYMELSSLRSEDTAVYYCARGGRYCSSTSCYSYYGLDVWGQGTTVTVSS

SEQ ID NO: 3487 - protein, 20 aa, Artificial Sequence
  Synthetic
ARGGRYCSSTSCYSYYGLDV

SEQ ID NO: 3488 - protein, 107 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYVFTFGPGTKVDIK

SEQ ID NO: 3489 - protein, 9 aa, Artificial Sequence
  Synthetic
QQYNSYVFT

SEQ ID NO: 3490 - protein, 130 aa, Artificial Sequence
  Synthetic
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARGPPLRDSSGYYYADYYYGMDVWGQGTTVTVSS

SEQ ID NO: 3491 - protein, 23 aa, Artificial Sequence
  Synthetic
ARGPPLRDSSGYYYADYYYGMDV

SEQ ID NO: 3492 - protein, 113 aa, Artificial Sequence
  Synthetic
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLYTFGQGTKLEIK

SEQ ID NO: 3493 - protein, 10 aa, Artificial Sequence
  Synthetic
MQALQTPLYT

SEQ ID NO: 3494 - protein, 116 aa, Artificial Sequence
  Synthetic
EVQLVESGGGLVQPGGSLRLSCAASGLTVSSNYMSWVRQAPGKGLEWVSLIYSGGSTYYADSVKGRFTISRDNSKNTLYLQMNSLRAEDTAVYYCARLRGRGFDYWGQGTLVTVSS

SEQ ID NO: 3495 - protein, 10 aa, Artificial Sequence
  Synthetic
ARLRGRGFDY

SEQ ID NO: 3496 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDTATYYCQQDDNLPITFGQGTRLEIK

SEQ ID NO: 3497 - protein, 9 aa, Artificial Sequence
  Synthetic
QQDDNLPIT

SEQ ID NO: 3498 - protein, 124 aa, Artificial Sequence
  Synthetic
EVQLVESGGGLVQPGRSLRLSCTASGFTFGGYAMTWFRQAPGKGLEWLGFIRSKAYGGTTEYAAAVKGRFTISRDDSKRIAYLQMNSLKTEDTAVYYCSRGWITTIVEDTFDIWGQGTMVTVSS

SEQ ID NO: 3499 - protein, 15 aa, Artificial Sequence
  Synthetic
SRGWITTIVEDTFDI

SEQ ID NO: 3500 - protein, 107 aa, Artificial Sequence
  Synthetic
EIVMTQSPATLSVSPGERATLSCRASQSVRGNLAWYQQKPGQAPRLLIYGASTRATGIPARFGGSVSGTEFTLTISSLQSEDFAVYYCQQYNNWPITFGQGTRLEIK

SEQ ID NO: 3501 - protein, 9 aa, Artificial Sequence
  Synthetic
QQYNNWPIT

SEQ ID NO: 3502 - protein, 116 aa, Artificial Sequence
  Synthetic
EVQLVESGGGLVQPGGSLRLSCAASELIVSSNYMSWVRQAPGKGLEWVSLIYSGGSTYYADSVKGRFTISRDNSKNTLYLQMNSLRPEDTAVYYCARLRGRGFDYWGQGTLVTVSS

SEQ ID NO: 3503 - protein, 10 aa, Artificial Sequence
  Synthetic
ARLRGRGFDY

SEQ ID NO: 3504 - protein, 107 aa, Artificial Sequence
  Synthetic
DIQMTQSPSSLSASVGDRVTVTCQASQDISNYLNWYQQKPGKAPKLLIYDASNLETGVPSRFSGSGSGTDFTFTISSLQPEDTATYYCQQDDNLPITFGQGTRLEIK

SEQ ID NO: 3505 - protein, 9 aa, Artificial Sequence
  Synthetic
QQDDNLPIT

SEQ ID NO: 3506 - protein, 131 aa, Artificial Sequence
  Synthetic
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYYARLIRDYNFWSGPHPPGEKGWFDPWGQGTLVTVSS

SEQ ID NO: 3507 - protein, 24 aa, Artificial Sequence
  Synthetic
ARLIRDYNFWSGPHPPGEKGWFDP

SEQ ID NO: 3508 - protein, 112 aa, Artificial Sequence
  Synthetic
DIVMTQTPLSSPVTLGQPASISCRSSQSLVHSDGNTYLSWLQQRPGQPPRLLIYKISNRISGVPDRFSASGAGTDFTLKISRVEAEDVGVYYCMQGTQFPLTFGGGTKVEIK

SEQ ID NO: 3509 - protein, 9 aa, Artificial Sequence
  Synthetic
MQGTQFPLT

SEQ ID NO: 3510 - protein, 125 aa, Artificial Sequence
  Synthetic
QVQLVQSGAEVKKPGSSVKVSCRGSGGNFSSYAISWVRQAPGQGLEWMGGIIPIFGTINYAQKFQGRVTITADESTSTAYMELDSLRSGDTAVYYCARGPPLTMILIAVYVMDVWGQGTTITVSS

SEQ ID NO: 3511 - protein, 18 aa, Artificial Sequence
  Synthetic
ARGPPLTMILIAVYVMDV

SEQ ID NO: 3512 - protein, 113 aa, Artificial Sequence
  Synthetic
DIVMTQSPDSLAVSLGERATINCKSSQNVLYSSNNKNYLAWYQQKPGQPPKLLIYWASTRESGVPDRFSGSGSGTDFTLTISSLQAEDVALYYCQQYYTTPPIFGQGTRLEIK

SEQ ID NO: 3513 - protein, 9 aa, Artificial Sequence
  Synthetic
QQYYTTPPI

SEQ ID NO: 3514 - protein, 121 aa, Artificial Sequence
  Synthetic
QVQLVESGGGVVQPGRSLRLSCAASGFTFSSYGMHWVRQAPGKGLEWVAVISDDGSYKDYADSVKGRFTISRDKSKNTLYLQMDSLRTEDTAMYYCAKEAQTAMVTYPDYWGQGTLVTVSS

SEQ ID NO: 3515 - protein, 14 aa, Artificial Sequence
  Synthetic
AKEAQTAMVTYPDY

SEQ ID NO: 3516 - protein, 108 aa, Artificial Sequence
  Synthetic
DIQMTQSPSSLSASVGDRVTITCRASQSINSYLNWYQQKPGKAPKLLIYAASSLQSGVPSRFSGGGSGTDFSLTISSLQPEDFATYYCQQSYNTPPWTFGQGTKVEFK

SEQ ID NO: 3517 - protein, 10 aa, Artificial Sequence
  Synthetic
QQSYNTPPWT

SEQ ID NO: 3518 - protein, 127 aa, Artificial Sequence
  Synthetic
QVQLVQSGAEVKKPGASVTVSCKASGYTFTSYGVSWVRQAPGQGLEWMGWISVYNGNIKYAQKLQGRVTMTTDTSTSTAYMELRSLISDDTAVYYCARRRPLAAAESYHYYFGMDVWGQGTTVTVSS

SEQ ID NO: 3519 - protein, 20 aa, Artificial Sequence
  Synthetic
ARRRPLAAAESYHYYFGMDV

SEQ ID NO: 3520 - protein, 112 aa, Artificial Sequence
  Synthetic
DIVMTQSPLSLPVTPGEPASISCRSSLSLLHSNGYNYLDWYLQKPGQSPQLLIYLSSNRASGVPDRFSGSGSGTDFTLKISRVEAEDVGVYYCMQALQTPYTFGQGTKLEIK

SEQ ID NO: 3521 - protein, 9 aa, Artificial Sequence
  Synthetic
MQALQTPYT

SEQ ID NO: 3522 - protein, 123 aa, Artificial Sequence
  Synthetic
QVQLVESGGGLVKPGGSLRLSCAASGFTFTDYFMTWIRQAPGKGLEWVSDISSTGATISYADSVEGRFTISRDNAKNSLYLQMNSLRAEDTAVYYCARDRRGYFDWSSNLDFWGQGTLVTVSS

SEQ ID NO: 3523 - protein, 16 aa, Artificial Sequence
  Synthetic
ARDRRGYFDWSSNLDF

SEQ ID NO: 3524 - protein, 112 aa, Artificial Sequence
  Synthetic
DVVMTQSPLSLPVTLGQPASISCRSSQSLVYSDGNTYLNWFQQRPGQSPRRLMYKVSNRDSGVPDRFSGSGSGTDFTLKISRVEAEDVGVYYCMQGIHWPPTFGQGTRLEIK

SEQ ID NO: 3525 - protein, 9 aa, Artificial Sequence
  Synthetic
MQGIHWPPT

SEQ ID NO: 3526 - protein, 116 aa, Artificial Sequence
  Synthetic
EVQLVESGGGLIQPGGSLRLSCAASGFTVSSNYMTWVRQAPGKGLEWVSVIYPGGSTFYADSVKGRFTISRDNSKNTLFLQMNSLRAEDTAVYYCARDRGGFGDYWGQGTLVTVSS

SEQ ID NO: 3527 - protein, 10 aa, Artificial Sequence
  Synthetic
ARDRGGFGDY

SEQ ID NO: 3528 - protein, 107 aa, Artificial Sequence
  Synthetic
DIQMTQSPSSLSASAGDRVTITCRASQGISNYLAWYQQKPGNAPKLLIYAASTLQSGVPSRFSGSGSGTDFTLTITSLQPEDVATYYYQKYNSAPPWTFGQGTKVEI

SEQ ID NO: 3529 - protein, 10 aa, Artificial Sequence
  Synthetic
QKYNSAPPWT

SEQ ID NO: 3530 - protein, 117 aa, Artificial Sequence
  Synthetic
EVQLVESGGGLMQPGGSLRLSCAASGLTVSSNYMNWVRQAPGKGLEWVSVIYSGGSTFYADSVKGRFTISRDNSKNTLFLQMSSLRAEDTAVYYCARDLVAYGMDVWGQGTTVTVSS

SEQ ID NO: 3531 - protein, 11 aa, Artificial Sequence
  Synthetic
ARDLVAYGMDV

SEQ ID NO: 3532 - protein, 106 aa, Artificial Sequence
  Synthetic
DIQLTQSPVSLSASVGDRVTITCRASQGISSYLAWYQQKPGKAPKLLIFAASTLQSGVPSRFSGSGSGTEFTLTISSLQPEDFATYYCQLLNSNPTFGPGTTVDIK

SEQ ID NO: 3533 - protein, 8 aa, Artificial Sequence
  Synthetic
QLLNSNPT

SEQ ID NO: 3534 - protein, 121 aa, Artificial Sequence
  Synthetic
EVQLVESGGGLVKPGGSLRLSCAASGFTFSNAWMSWVRQAPGKGLEWVGRIKSKIDGGTTDYAAPVKGRFTISRDDSKNTLYLQMNSLKTEDTAVYYCTTDPDYSSSSIYWGQGTLVTVSS

SEQ ID NO: 3535 - protein, 12 aa, Artificial Sequence
  Synthetic
TTDPDYSSSSIY

SEQ ID NO: 3536 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTRWTFGQGTKVEIK

SEQ ID NO: 3537 - protein, 9 aa, Artificial Sequence
  Synthetic
QQSYSTRWT

SEQ ID NO: 3538 - protein, 118 aa, Artificial Sequence
  Synthetic
EVQLVESGGGLIQPGGSLRLSCAASGLIVSRNYMSWVRQAPGKGLEWVSVIYSGGSTFYADSVKGRFTISRDNSKNTLYLQMNSLGGEDTAVYYCVRDLGMVGGTDSWGQGTLVTVSS

SEQ ID NO: 3539 - protein, 12 aa, Artificial Sequence
  Synthetic
VRDLGMVGGTDS

SEQ ID NO: 3540 - protein, 109 aa, Artificial Sequence
  Synthetic
EIVMTQSPATLSVSPGERATLSCRASQSVSSNLAWYQQRPGQAPRLLIYGASTRATGIPARFSGSGSGTEFTLTISSLQSEDFAVYYCQQYNNWPPMYTFGQGTKLEIK

SEQ ID NO: 3541 - protein, 11 aa, Artificial Sequence
  Synthetic
QQYNNWPPMYT

SEQ ID NO: 3542 - protein, 127 aa, Artificial Sequence
  Synthetic
EVQLVESGGGLVQPGRSLRLSCAASGFTFDDYAIHWVRQAPGKGLEWVSGISWNGGVIGYADSVKGRFTISRDNAKNSLYLQMNRLRADDTAYYYCARDNRGRGGLEDYNYYGMDVWGQGTTVTVSS

SEQ ID NO: 3543 - protein, 20 aa, Artificial Sequence
  Synthetic
ARDNRGRGGLEDYNYYGMDV

SEQ ID NO: 3544 - protein, 107 aa, Artificial Sequence
  Synthetic
DIQMTQSPSSLSASVGDRVTITCRASQTISTYLNWYQQKPGKAPELLIYAASSLQSGVPSRFSGSGSGTDFTLTISSLQPEDFATYYCQQSYSTPPTFGGGTKVEIK

SEQ ID NO: 3545 - protein, 9 aa, Artificial Sequence
  Synthetic
QQSYSTPPT

SEQ ID NO: 3546 - protein, 128 aa, Artificial Sequence
  Synthetic
QVQLVQSGAEVKKPGASVKVSCKASGYTFTDYYMHWVRQAPGQGLEWMGWIIPNSGGTNFAQKFQGRVTMTRDTSISTAYMELSRLRSDDTAVYYCARDVWELLLTTGGRVEGRFDYWGQGTLVTVSS

SEQ ID NO: 3547 - protein, 21 aa, Artificial Sequence
  Synthetic
ARDVWELLLTTGGRVEGRFDY

SEQ ID NO: 3548 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPHTFGQGTKLEIK

SEQ ID NO: 3549 - protein, 9 aa, Artificial Sequence
  Synthetic
QQSYSTPHT

SEQ ID NO: 3550 - protein, 126 aa, Artificial Sequence
  Synthetic
QVQLVQSGAEVKKPGASVKVSCKASGYTFTDFGIGWVRQAPGQGLEWMGWISTYNAITNYAQKFQGRVTMIADTSTSTAYMELRSLRSDDTAVYYCARDPPYYYGSGSPLAGMDVWGQGTTVTVSS

SEQ ID NO: 3551 - protein, 19 aa, Artificial Sequence
  Synthetic
ARDPPYYYGSGSPLAGMDV

SEQ ID NO: 3552 - protein, 107 aa, Artificial Sequence
  Synthetic
EIVLTQSPATLSLSPGERATLSCRASQSVSSYLAWYQQKPGQAPRLLYEASNRASGIPAKFSGSGSGTDFTLTISSVEPEDFAVYYCQQRSNWPGLTFGGGTKVEIK

SEQ ID NO: 3553 - protein, 10 aa, Artificial Sequence
  Synthetic
QQRSNWPGLT

SEQ ID NO: 3554 - protein, 117 aa, Artificial Sequence
  Synthetic
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGEYYFDYWGQGTLVTVSS

SEQ ID NO: 3555 - protein, 11 aa, Artificial Sequence
  Synthetic
ARDWGEYYFDY

SEQ ID NO: 3556 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIK

SEQ ID NO: 3557 - protein, 9 aa, Artificial Sequence
  Synthetic
QQYGSSPRT

SEQ ID NO: 3558 - protein, 124 aa, Artificial Sequence
  Synthetic
QVQLVQSGAEVKKPGASVKVSCKASGYTFTGYFIHWVRQAPGQGLEWMGWIDPNSGGTNYAQKFRARVTMTRDTSITTAYMELSRLRSDDTAVYYCARESAVMYSSPDSLFDPWGQGTLVTVSS

SEQ ID NO: 3559 - protein, 17 aa, Artificial Sequence
  Synthetic
ARESAVMYSSPDSLFDP

SEQ ID NO: 3560 - protein, 105 aa, Artificial Sequence
  Synthetic
DIQLTQSPSFLSASVGDRVTITCRASQGISRYLAWYQQKPGKAPKVLIYAASTLQSGVPSRFSGSGSGTEFTLTISSLQPEDFATYYCQQLNSYTFGQGTRLEIK

SEQ ID NO: 3561 - protein, 7 aa, Artificial Sequence
  Synthetic
QQLNSYT

SEQ ID NO: 3562 - protein, 118 aa, Artificial Sequence
  Synthetic
EVQLVESGGGLIQPGGSLRLSCAASGVTVSSNYMSWVRQAPGKGLEWVSVMYSGGSTFYADSVKGRFTISRDNSKNTLYLQMNSLRAEDTAVYYCARDLLVVGGTDYWGQGTLVTVSS

SEQ ID NO: 3563 - protein, 12 aa, Artificial Sequence
  Synthetic
ARDLLVVGGTDY

SEQ ID NO: 3564 - protein, 109 aa, Artificial Sequence
  Synthetic
EIVLTQSPGTLSLSPGERATLSCRASQSVSSSDLAWYQQKPGQAPRLLIYGASSRATGIPDRFSGSGFGTDFTLTISRLEPEDFAVYYCQQYGSSPPWTFGQGTKVEIK

SEQ ID NO: 3565 - protein, 10 aa, Artificial Sequence
  Synthetic
QQYGSSPPWT

SEQ ID NO: 3566 - protein, 130 aa, Artificial Sequence
  Synthetic
EVQLVESGGGLVQPGRSLRLSCAASGFTFDDYAMHWVRQAPGKGLEWVSGISWNSGTIGYADSVKGRFTISRDSAKKSLYLQMNSLRAEDTALYYCARGSAYYYDSSSGYYSDEGPFDYWGQGTLVTVSS

SEQ ID NO: 3567 - protein, 23 aa, Artificial Sequence
  Synthetic
ARGSAYYYDSSSGYYSDEGPFDY

SEQ ID NO: 3568 - protein, 105 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYSFGGGTKVEIK

SEQ ID NO: 3569 - protein, 7 aa, Artificial Sequence
  Synthetic
QQYNSYS

SEQ ID NO: 3570 - protein, 117 aa, Artificial Sequence
  Synthetic
EVQLVESGGGLVQPGGSLRLSCAASGITVSANYMTWVRQAPGKGLEWVSVIYSGGSTFYADSVKGRFTISRDNSKNTLYLQMNSLRVEDTAVYYCVRDLGPYGMDVWGQGTTVTVSS

SEQ ID NO: 3571 - protein, 11 aa, Artificial Sequence
  Synthetic
VRDLGPYGMDV

SEQ ID NO: 3572 - protein, 103 aa, Artificial Sequence
  Synthetic
EIVMTQSPATLSVSPGERATLSCRASQSVSSDLAWYQQKPGQAPRLLIYGASTRATGIPARFSGSESGTEFTLTISSLQSEDFAVYYCQHEETFGQGTRLEIK

SEQ ID NO: 3573 - protein, 5 aa, Artificial Sequence
  Synthetic
QHEET

SEQ ID NO: 3574 - protein, 127 aa, Artificial Sequence
  Synthetic
QVQLVESGGGVVQPGRSLRLSCAASGFTFSSYGMHWVRQAPGKGLEWVAVISYDGSNKYYEDSVKGRFTISRDNSKNTLYLQMNSLRAEDTAVYYCAQDGRYYDSSGYLGTYYFDYWGQGNLVTVSS

SEQ ID NO: 3575 - protein, 20 aa, Artificial Sequence
  Synthetic
AQDGRYYDSSGYLGTYYFDY

SEQ ID NO: 3576 - protein, 108 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNWPPWTFGQGTKVEIK

SEQ ID NO: 3577 - protein, 10 aa, Artificial Sequence [sequence omitted]

SEQ ID NO: 3578 - protein, 125 aa, Artificial Sequence
  Synthetic
QVQLVQSGAEVKKPGSSVKVSCKAAGGTFSSYGISWVRQAPGQGLEWMGGIIPIFGTVKYAQKFRGRVTVTADESTSTAYMELSSLRSADTAVYYCARDLPLTMTTVTTSLSDYWGQGTPVTVSS

SEQ ID NO: 3579 - protein, 18 aa, Artificial Sequence
  Synthetic
ARDLPLTMTTVTTSLSDY

SEQ ID NO: 3580 - protein, 113 aa, Artificial Sequence
  Synthetic
DIVMTQSPDSLAVSLGERATINCKSSQSVLYSSNNKNYLAWYQQKPGQPPKLLIYWASTRESGVPDRFSGSGSGTDFSLTISSLQAEDVAVYYCQQYYRTPPTFGQGTKVEIK

SEQ ID NO: 3581 - protein, 9 aa, Artificial Sequence
  Synthetic
QQYYRTPPT

SEQ ID NO: 3582 - protein, 119 aa, Artificial Sequence
  Synthetic
EVQLVESGGGLVQPGGSLRLSCEASGITVSSNYMSWVRQAPGKGLEWVSLIYSGGSTFYAESVKGRFTISRDSSKNTLYLQMNSLRAEDTAVYYCARDRPRHADAFDIWGQGTLVTVSS

SEQ ID NO: 3583 - protein, 13 aa, Artificial Sequence
  Synthetic
ARDRPRHADAFDI

SEQ ID NO: 3584 - protein, 108 aa, Artificial Sequence
  Synthetic
DIQMTQSPSSLSASVGDRITITCQASQDISNYLNWYQQKPGKAPKLLIYDASNLETGVPSRFSGSGSGTDFTFTISSLQPEDIATYYCQHYDNLPSFTFGPGTKVDIK

SEQ ID NO: 3585 - protein, 10 aa, Artificial Sequence
  Synthetic
QHYDNLPSFT

SEQ ID NO: 3586 - protein, 124 aa, Artificial Sequence
  Synthetic
EVQLVESGGGLVQPGRSLRLSCAASGFTFDDYAMHWVRQAPGKGLEWVSGMSWNSGTIGYADSVKGRFTISRDNAQNSLYLQMNTLRAEDTALYYCAKDIGPGETYSSSFFDFWGQGTLVTVSS

SEQ ID NO: 3587 - protein, 17 aa, Artificial Sequence
  Synthetic
AKDIGPGETYSSSFFDF

SEQ ID NO: 3588 - protein, 108 aa, Artificial Sequence
  Synthetic
EIVLTQSPGTLSLSPGERATLSCRASQSVSSRYLAWYQQKPGQAPRLLIYGASSRATGIPDRFSGSGSGTDFTLTISRLEPEDFAVYYCQHYGSSSYTFGQGTKLEIK

SEQ ID NO: 3589 - protein, 9 aa, Artificial Sequence
  Synthetic
QHYGSSSYT

SEQ ID NO: 3590 - protein, 118 aa, Artificial Sequence
  Synthetic
EVQLVESGGGLVQPGGSLRLSCAASEITVSSNYMSWVRQAPGKGLEWVSVIYSGGSTYYADSVKGRFTISRDNSKNTLYLQMNSLRAEDTAVYYCARDLSVAGAFDIWGQGTMVTVSS

SEQ ID NO: 3591 - protein, 12 aa, Artificial Sequence
  Synthetic
ARDLSVAGAFDI

SEQ ID NO: 3592 - protein, 105 aa, Artificial Sequence
  Synthetic
DIQLTQSPSFLSASVGDRVTITCRASQGISSYLAWYQQKPGRAPKLLIYAASTLQSGVPSRFSGSGSGTEFTLTISSLQPEDFATYYCQQLDSYSFGPGTKVDIK

SEQ ID NO: 3593 - protein, 7 aa, Artificial Sequence
  Synthetic
QQLDSYS

SEQ ID NO: 3594 - protein, 127 aa, Artificial Sequence
  Synthetic
QVQLQESGPGLVKPSQTLSLTCTVSGGSISSDDYYWSWIRQPPGKGLEWIGYISYIGSTSYNPSLKSRVTVSVDTSKNQFSLKLTSVTAADTAVYYCARTYYYDSSGNYFQYYFDYWGQGTLVTVSS

SEQ ID NO: 3595 - protein, 19 aa, Artificial Sequence
  Synthetic
ARTYYYDSSGNYFQYYFDY

SEQ ID NO: 3596 - protein, 108 aa, Artificial Sequence
  Synthetic
EIVLTQSPGTLSLSPGERATLSCRASKSVSSGYLAWYQQKPGQAPRLLIYGASSRATGIPDRFSGSGSGTDFTLTISRLEPEDFAVYYCQQYGSSPLTFGGGTKVEIK

SEQ ID NO: 3597 - protein, 9 aa, Artificial Sequence
  Synthetic
QQYGSSPLT

SEQ ID NO: 3598 - protein, 129 aa, Artificial Sequence
  Synthetic
QVQLQESGPGLVKPSQTLSLTCTVSGGSISSGSYYWSWIRQPAGKGLEWIGRLYTTGSTNYNPSLKSRVTISADTSKNQFSLKLSSVTAADTAVYYCARVVLRGGSGYYYGSVDWFDPWGQGTLVTVSS

SEQ ID NO: 3599 - protein, 21 aa, Artificial Sequence
  Synthetic
ARVVLRGGSGYYYGSVDWFDP

SEQ ID NO: 3600 - protein, 107 aa, Artificial Sequence
  Synthetic
EIVLTQSPATLSLSPGERATLSCRASQSVSNYLAWYQQKPGQAPRLLIYDASNRATGIPARFSGSGSGTDFTLTISSLEPEDFAVYYCQQRSNWPPTFGGGTKVEIK

SEQ ID NO: 3601 - protein, 9 aa, Artificial Sequence
  Synthetic
QQRSNWPPT

SEQ ID NO: 3602 - protein, 120 aa, Artificial Sequence
  Synthetic
QVQLVESGGGVVQPGRSLRLSCAASGFTFSSYAMHWVRQAPGKGLEWVAVISYDGGYKHYADSVKGRFTISRDNSKNTLYLQMNSLRAEDTAVFYCARDEGPMVTWFDYWGQGTLVTVSS

SEQ ID NO: 3603 - protein, 13 aa, Artificial Sequence
  Synthetic
ARDEGPMVTWFDY

SEQ ID NO: 3604 - protein, 108 aa, Artificial Sequence
  Synthetic
DIQMTQSPSSLSASVGDRVTITCRASQSISSYLNWYQQRPGKAPKLLIYTASSLQSGVPSRFSGSGSGTDFTLTISSLQPEDFATYYCQQSYSTPPWTFGQGTKVEIK

SEQ ID NO: 3605 - protein, 10 aa, Artificial Sequence
  Synthetic
QQSYSTPPWT

SEQ ID NO: 3606 - protein, 128 aa, Artificial Sequence
  Synthetic
EVQLVESGGGLVKPGGSLRLSCAASGFSFSNAWMSWVRQAPGKGLEWVGRVKSKTHGGTTDYAAPVKGRFTISRDDSKNTLYLQMNSLKTEDTAVYYCTTVSQFLEWLLDEDNALDIWGQGTMVTVSS

SEQ ID NO: 3607 - protein, 19 aa, Artificial Sequence
  Synthetic
TTVSQFLEWLLDEDNALDI

SEQ ID NO: 3608 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYYNSPYTFGQGTKLDIK

SEQ ID NO: 3609 - protein, 9 aa, Artificial Sequence
  Synthetic
QQYYNSPYT

SEQ ID NO: 3610 - protein, 122 aa, Artificial Sequence
  Synthetic
QVQLVQSGAEVKKPGASVKVSCKASGYSFTNYYMHWVRQAPGQGLEWMGIINPGGGSTTYTQKLQGRVTMTRDTSTSTVHMELSSLRSEDTAVYYCARGALIPDAHDAFDIWGQGTMVTVSS

SEQ ID NO: 3611 - protein, 15 aa, Artificial Sequence
  Synthetic
ARGALIPDAHDAFDI

SEQ ID NO: 3612 - protein, 108 aa, Artificial Sequence
  Synthetic
DIQMTQSPSTLSASVGDRVTITCRASQSISRWLAWYQQKPGKAPKLLIYKSSTLESGVPSRFSGSGSGTEFTLTISSLQPDDFATYYCQQYNSYYLATFGPGTKVDIK

SEQ ID NO: 3613 - protein, 10 aa, Artificial Sequence
  Synthetic
QQYNSYYLAT

SEQ ID NO: 3614 - protein, 123 aa, Artificial Sequence
  Synthetic
QVQLVQSGAEVKKPGASVKVSCKASGYTFTTYYMHWVRQAPGQGLEWMGIINPSGGSTTYAQKFQGRVTMTGDTSTSTVYMALSSLTSEDTALYYCAREGTLVPAAPHYLEYWGQGTLVTVSS

SEQ ID NO: 3615 - protein, 16 aa, Artificial Sequence
  Synthetic
AREGTLVPAAPHYLEY

SEQ ID NO: 3616 - protein, 108 aa, Artificial Sequence
  Synthetic
EIVLTQSPATLSLSPGERATLSCRASQSVSYLAWYQQKPGQAPRLLIYDASNRATDIPARFSGSGSGTDFTLTISSLEPEDFAVYYCQQRSNWPPEITFGPGTKVDIK

SEQ ID NO: 3617 - protein, 11 aa, Artificial Sequence
  Synthetic
QQRSNWPPEIT

SEQ ID NO: 3618 - protein, 120 aa, Artificial Sequence
  Synthetic
QVQLVQSGAEVKKPGASVRVSCKASGYTFMNYGISWVRQAPGQGLEWMGWISGYNGNTKYAQKFQGRVTLTTDTSTSTAYMELRSLRSDDTAVYYCARDGCSGDTCFDPWGQGTLVTVSS

SEQ ID NO: 3619 - protein, 13 aa, Artificial Sequence
  Synthetic
ARDGCSGDTCFDP

SEQ ID NO: 3620 - protein, 112 aa, Artificial Sequence
  Synthetic
DIVMTQTPLSLSVTPGQPASISCKSSQSLLHSDGKTYLYWFLQKPGQPPQLLIHEISNRFSGVPDRFSGSGSGTDFTLKISRVEAEDVGSYYCMQSIQLPITFGQGTRLEIK

SEQ ID NO: 3621 - protein, 9 aa, Artificial Sequence
  Synthetic
MQSIQLPIT

SEQ ID NO: 3622 - protein, 123 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGGWYSSSSGPWFDYWGQGTLVTVSS

SEQ ID NO: 3623 - protein, 16 aa, Artificial Sequence
  Synthetic
AKGGWYSSSSGPWFDY

SEQ ID NO: 3624 - protein, 108 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPPYTFGQGTKLEIK

SEQ ID NO: 3625 - protein, 10 aa, Artificial Sequence
  Synthetic
QQYDNLPPYT

SEQ ID NO: 3626 - protein, 120 aa, Artificial Sequence
  Synthetic
EVQLVQSGAEVKKPGESLKISCKGSGYSFISYWIAWVRQMPGKGLEWMGIIYPGDSDTRYTPSFQGQVTISADKSVSTAYLQWSSLKASDTAMYYCARWDGGSYPNADLWGQGTLVTVSS

SEQ ID NO: 3627 - protein, 13 aa, Artificial Sequence
  Synthetic
ARWDGGSYPNADL

SEQ ID NO: 3628 - protein, 106 aa, Artificial Sequence
  Synthetic
DIQMTQSPSSLSASVGDRVTITCRASQTISIYLNWYQQKPGKAPKLLIYAASSLQSGVPSRFSGSGSGTDFTLTISSLQPEDFATYYCQQSYSSLYTFGQGTKLEI

SEQ ID NO: 3629 - protein, 9 aa, Artificial Sequence
  Synthetic
QQSYSSLYT

SEQ ID NO: 3630 - protein, 124 aa, Artificial Sequence
  Synthetic
EVQLVESGGDLVQPGGSLRLSCAASGFTFSSYEMNWVRQTPGKGLEWLSYISGSSSTIYHADSVKGRFTISRDNAENSLYLQMNSLRAEDTGIYYCARVWSLFTRYYFYGMDVWGRGTTVTVSS

SEQ ID NO: 3631 - protein, 17 aa, Artificial Sequence
  Synthetic
ARVWSLFTRYYFYGMDV

SEQ ID NO: 3632 - protein, 111 aa, Artificial Sequence
  Synthetic
QSVLTQPPSVSGAPGQRVTISCTGSSSNIGAGYDVHWYQQLPGTAPKLLIYGNTNRPSGVPDRFSGSKSGASASLAITGLQADDEADYYCQSYDNSLSAWVFGGGTKLTVL

SEQ ID NO: 3633 - protein, 11 aa, Artificial Sequence
  Synthetic
QSYDNSLSAWV

SEQ ID NO: 3634 - protein, 118 aa, Artificial Sequence
  Synthetic
QVQLVESGGGVVQPGRSLRLSCAASGFTFTTYGMHWVRQAPGKGLEWMAIIWNDGSNKYYADSVKGRFTISRDNSKNTLSLQMNSLRAEDTAVYYCARGLAAGAFDIWGQGTMVTVSS

SEQ ID NO: 3635 - protein, 11 aa, Artificial Sequence
  Synthetic
ARGLAAGAFDI

SEQ ID NO: 3636 - protein, 108 aa, Artificial Sequence
  Synthetic
SYVLTQPPSVSVAPGKTARITCGGNNIGSQSVHWYQQRPGQAPVLVIYFDSDRPSGIPERFSGSNSGNTATLTISRVEAGDEADYSCQVWDTSSESGVFGGGTKLTVL

SEQ ID NO: 3637 - protein, 11 aa, Artificial Sequence
  Synthetic
QVWDTSSESGV

SEQ ID NO: 3638 - protein, 125 aa, Artificial Sequence
  Synthetic
QVQLVQSGAEVKKPGASVKVSCKASGYIFTNYGITWVRQAPGQGLEWMGWISAYNGHTNYAQKFQGRVTMTTDTSTSTAYMEVRSLRSDDTAVYYCARDMMGIVVVDQDYGMDVWGQGTTVSVSS

SEQ ID NO: 3639 - protein, 18 aa, Artificial Sequence
  Synthetic
ARDMMGIVVVDQDYGMDV

SEQ ID NO: 3640 - protein, 107 aa, Artificial Sequence
  Synthetic
SYVLTQPSSVSVSPGQTARITCSGDILAKKYVRWFQQKPGQAPVLVIYKDRERPSGIPERFSGSSSGTTVTLTISGAQVEDETDYYCYSTPDNNHGVFGGGTKLTVL

SEQ ID NO: 3641 - protein, 10 aa, Artificial Sequence
  Synthetic
YSTPDNNHGV

SEQ ID NO: 3642 - protein, 127 aa, Artificial Sequence
  Synthetic
QVQLVQSGAEVKKPGASVKVSCKASGYTFTSYGISWVRQAPGQGLEWMGWISAYNGNTNFAQKLQGRVTMTTDTSTSTAYMEMRSLTSDDTAVYYCARETPPAYSSSNHYYYGMDVWGQGTTVTVSS

SEQ ID NO: 3643 - protein, 20 aa, Artificial Sequence
  Synthetic
ARETPPAYSSSNHYYYGMDV

SEQ ID NO: 3644 - protein, 110 aa, Artificial Sequence
  Synthetic
SYELTQPPSVSVSPGQTARITCSGDALPKQYAYWYQQKPGQAPVLVIYKDSERPSGIPERFSGSSSGTTVTLTISGVQAEDEAEYYCQSADSSGSRPNWVFGGGTKLTVL

SEQ ID NO: 3645 - protein, 13 aa, Artificial Sequence
  Synthetic
QSADSSGSRPNWV

SEQ ID NO: 3646 - protein, 123 aa, Artificial Sequence
  Synthetic
QVQLVESGGGVVQPGRSLRLSCAASGFTFSSYAMHWVRQSPGKGLDWVAVISDDGINKYYADSVKGRFTISRDNSKNSLYLQMNSLRPEDTAVYYCARVSLGSGYSHPPFAYWGQGTLVTVSS

SEQ ID NO: 3647 - protein, 16 aa, Artificial Sequence
  Synthetic
ARVSLGSGYSHPPFAY

SEQ ID NO: 3648 - protein, 108 aa, Artificial Sequence
  Synthetic
SYVLTQPPSVSVAPGQTAKITCGGNSLGSKSVHWYQQKPGQAPVLVVYDDSDRPSGIPERFSGSNSVNTATLTISRVEAGDEADYYCQVWDSSSDHQVFGGGTKLTVL

SEQ ID NO: 3649 - protein, 11 aa, Artificial Sequence
  Synthetic
QVWDSSSDHQV

SEQ ID NO: 3650 - protein, 122 aa, Artificial Sequence
  Synthetic
QVQLQESGPGLVKPSQTLSLTCTVSGASMSIGDYYWSWIRQHPGKGLEWIGYIYYSGSTYYNPSLKSRVFISVDTSKNQFSLKLSSVTAADTAVYYCARFKRWAPHYYFDVWGRGSLVTVSS

SEQ ID NO: 3651 - protein, 14 aa, Artificial Sequence
  Synthetic
ARFKRWAPHYYFDV

SEQ ID NO: 3652 - protein, 109 aa, Artificial Sequence
  Synthetic
QSALTQPPSASGSPGQSVTISCTGTRSDVGGYNYVSWYQQHPGKAPKLMIYEVNQRPSGVPDRFSGSKSGNTASLTVSGLQAEDEADYYCSSHVGTNNLFGGGTKLTVL

SEQ ID NO: 3653 - protein, 9 aa, Artificial Sequence
  Synthetic
SSHVGTNNL

SEQ ID NO: 3654 - protein, 124 aa, Artificial Sequence
  Synthetic
QVQLVQSGAEVKKPGSSVKVSCKASGGTFSSYTIIWVRQAPGQGLEWMGRIIPILGIPNYAQKFQDRVTITADKATNTVYMDLSSLRSEDTAVYYCARLRGYSGYGAAGYFDYWGQGTLVTVSS

SEQ ID NO: 3655 - protein, 17 aa, Artificial Sequence
  Synthetic
ARLRGYSGYGAAGYFDY

SEQ ID NO: 3656 - protein, 111 aa, Artificial Sequence
  Synthetic
QSVLTQPPSVSGAPGQRVTISCTGSNSNIGAGYDVHWYRQLPGTAPKLLIYINTNRPSGVPDRFSGSKSGTSASLAIIGLQAEDEADYYCQSYDSSLSVEVFGTGTKVTVL

SEQ ID NO: 3657 - protein, 11 aa, Artificial Sequence
  Synthetic
QSYDSSLSVEV

SEQ ID NO: 3658 - protein, 120 aa, Artificial Sequence
  Synthetic
QVQLQESGPGLVKPSQTLSLTCSVSGGSISSDSYYWSWIRQPAGKGLEWIGRMYASESTNYNPSLKSRVTISADTSKNQFSLKLISVTAADTAVYYCASSYYDFWKFDYWGQGTLVTVSS

SEQ ID NO: 3659 - protein, 12 aa, Artificial Sequence
  Synthetic
ASSYYDFWKFDY

SEQ ID NO: 3660 - protein, 109 aa, Artificial Sequence
  Synthetic
NFMLTQPHSVSESPGKTVTISCTRSSGSIASNYVQWYQQRPGSSPTTVIYEDNQRPSGVPDRFSGSIDSSSNSASLTISGLKTEDEADYYCQSFHSYIPVFGGGTKLTV

SEQ ID NO: 3661 - protein, 9 aa, Artificial Sequence
  Synthetic
QSFHSYIPV

SEQ ID NO: 3662 - protein, 129 aa, Artificial Sequence
  Synthetic
QVQLVQSGAEVKKPGASVKVSCKASGYTFTTHGISWVRQAPGQGLEWMGWISAYNGYTKYAQKFQGRVTMTTATSTDTAYMELRSLRSDDTAVYYCARHLIAVAGTLILSPPGWGYDYWGQGTLVTVSS

SEQ ID NO: 3663 - protein, 22 aa, Artificial Sequence
  Synthetic
ARHLIAVAGTLILSPPGWGYDY

SEQ ID NO: 3664 - protein, 107 aa, Artificial Sequence
  Synthetic
SYVLTQPPSVSVSPGQTARITCSGDALSKEYVYWYQQKPGQAPVLVIYKDSERPSGIPERFSGSSSGTTVSLTISGVQAEDEADYYCQSADSSGTYSFGEGTKLTVL

SEQ ID NO: 3665 - protein, 10 aa, Artificial Sequence
  Synthetic
QSADSSGTYS

SEQ ID NO: 3666 - protein, 125 aa, Artificial Sequence
  Synthetic
QVQLVQSGAEVKKPGSSVKVSCKASGGSFSSYTISWVRQAPGQGLEWMGRIIPALGIANDAQKFQGRVTITADKSTTTAYMELSSLTSEDTAVYYCARDRVFGYSSGSARYFDLWGRGTLVTVSS

SEQ ID NO: 3667 - protein, 18 aa, Artificial Sequence
  Synthetic
ARDRVFGYSSGSARYFDL

SEQ ID NO: 3668 - protein, 111 aa, Artificial Sequence
  Synthetic
QSVLTQPPSVSGAPGQRVTISCTGSSSNIGAGYDVHWYQQFSGTAPKLLIYGNTNRPSGVPDRFSGSRSDTSASLAITGLQAEDEADYYCQSYDSSLSDSVFGTGTKVTVL

SEQ ID NO: 3669 - protein, 11 aa, Artificial Sequence
  Synthetic
QSYDSSLSDSV

SEQ ID NO: 3670 - protein, 134 aa, Artificial Sequence
  Synthetic
QVQLVESGGGVVQPGRSLRLSCAASGFTFNNYGIHWVRQAPGKGLEWVAVISYDGSKKYYADSVKGRFTISRDNSKNTLFVQMNSLRAEDTAVYYCAKDLGYCSNGVCRYGRSVDYYYYGMDVWGQGTTVTVSS

SEQ ID NO: 3671 - protein, 27 aa, Artificial Sequence
  Synthetic
AKDLGYCSNGVCRYGRSVDYYYYGMDV

SEQ ID NO: 3672 - protein, 110 aa, Artificial Sequence
  Synthetic
QSVLTQPPSASGTPGQRVTISCSGSSSNIGSNNVNWYQQFPGTAPKLLIYSNNQRPTGVPDRFSGSKSGTSASLAISGLQSEDEADYYCATWDDSLSGWVFGGGTELTVL

SEQ ID NO: 3673 - protein, 11 aa, Artificial Sequence
  Synthetic
ATWDDSLSGWV

SEQ ID NO: 3674 - protein, 130 aa, Artificial Sequence
  Synthetic
EVQLVESGGGLVKPGGSLRLSCAASGFSFSTYSMNWVRQAPGKGLEWVSSISSSSTYIYYADSVKGRFTISRDNAENSLYLQMNSLRVEDTALYYCARDFRRYCSSSSCYWFGYYGMDVWGQGTTVTVSS

SEQ ID NO: 3675 - protein, 23 aa, Artificial Sequence
  Synthetic
ARDFRRYCSSSSCYWFGYYGMDV

SEQ ID NO: 3676 - protein, 109 aa, Artificial Sequence
  Synthetic
QSALTQPASVSGSPGQSITISCAGTSSDVGAYKYVSWYQQHPGKAPKLMIYEVSNRPSGVSDRFSGSKSGNTASLTISGLQAEDEADYYCSSYTTRTTLVFGGGTKLTV

SEQ ID NO: 3677 - protein, 10 aa, Artificial Sequence
  Synthetic
SSYTTRTTLV

SEQ ID NO: 3678 - protein, 126 aa, Artificial Sequence
  Synthetic
QVQLQESGPGLVKPSQTLSLTCTVSGGSINSGNYYWSWIRQPAGKGLEWIGRINTSGSTNYNPSLKRRVTISVDTSKNQFSLKLTSVTAADTAVYYCARVGVLFSGYDETAPFDYWGQGVVVSVSS

SEQ ID NO: 3679 - protein, 18 aa, Artificial Sequence
  Synthetic
ARVGVLFSGYDETAPFDY

SEQ ID NO: 3680 - protein, 109 aa, Artificial Sequence
  Synthetic
SYVLTQPPSVSVAPGKTARITCGGNNIGSKSVHWYQQKPGQAPVLVIYYDRDRPSGIPERFSGSNSGNTATLTISRVEAGDEADYYCQVWDSSSDHQGVFGGGTKLTVL

SEQ ID NO: 3681 - protein, 12 aa, Artificial Sequence
  Synthetic
QVWDSSSDHQGV

SEQ ID NO: 3682 - protein, 125 aa, Artificial Sequence
  Synthetic
EVQLVESGGGLVQPGGSLRLSCAASGFTFSRYWITWVRQAPGKGLEWVANINQDGSETYYMDSMEGRFTISRDNAKNSLYLQMNSLRAEDTAVYYCARAIVDIVAPGTPDWFDPWGQGTLVTVSS

SEQ ID NO: 3683 - protein, 18 aa, Artificial Sequence
  Synthetic
ARAIVDIVAPGTPDWFDP

SEQ ID NO: 3684 - protein, 106 aa, Artificial Sequence
  Synthetic
SYELTQPPSVSVSPGQTARITCSGDAFPKQYVYWYQQKPGQAPVVVIYKDTERPSGIPERFSGSSSGTTVTLTISGVQAEDEADYYCQSADSSGVVFGGGTKLTVL

SEQ ID NO: 3685 - protein, 9 aa, Artificial Sequence
  Synthetic
QSADSSGVV

SEQ ID NO: 3686 - protein, 135 aa, Artificial Sequence
  Synthetic
QVQLQESGPGLVKPSQTLSLTCTVSGGSMNSGDYYWTWIRQHRGKGLEWIGYIYYSGRRDIYNSGSTYYNPALKSRITISADTSKNQFSLKLSSVTVADTAVYYCARVGWGHSGYDYANDNFDIWGQGTMVTVSS

SEQ ID NO: 3687 - protein, 19 aa, Artificial Sequence
  Synthetic
ARVGWGHSGYDYANDNFDI

SEQ ID NO: 3688 - protein, 111 aa, Artificial Sequence
  Synthetic
QSVLTQPPSASGTPGQRVTISCSGSSSNIGSSPVNWYQHLPGTAPKLLIYTNNQRPSGVPDRFSGSKSGTSASLAISGLQSEDEADYYCAAWDDSLNGYVVFGGGTKLTVL

SEQ ID NO: 3689 - protein, 12 aa, Artificial Sequence
  Synthetic
AAWDDSLNGYVV

SEQ ID NO: 3690 - protein, 121 aa, Artificial Sequence
  Synthetic
QVQLVQSGAEVKKPGASVKISCKASGYTFTSYYMHWVRQAPGQGLEWVGIIYPSVGSTSYAQKFQGRVTMTRDTSTSTVYMELSSLRSEDTAVYYCASEPSDTLTGYYNYWGQGTLVTVSS

SEQ ID NO: 3691 - protein, 14 aa, Artificial Sequence
  Synthetic
ASEPSDTLTGYYNY

SEQ ID NO: 3692 - protein, 109 aa, Artificial Sequence
  Synthetic
SYVLTQPPSVSVAPGQTARITCEENNIGSKNVHWYQQKPGQAPVLVVYDDSDRPSGIPERFSGSNSGNTATLTISRVEAGDEADYYCQVWDSSRDRHYVFGTGTKVTVL

SEQ ID NO: 3693 - protein, 12 aa, Artificial Sequence
  Synthetic
QVWDSSRDRHYV

SEQ ID NO: 3694 - protein, 121 aa, Artificial Sequence
  Synthetic
EVQLVQSGAEVKKPGESLKISCKASGYNFTNYWIAWVRQMPGKGLEWMGIIYPGDSDTRYSPSFQGQVTISADKSISTAFLQWRSLKASDSAMYFCARKSGSYYNRNFDYWGQGTLVTVSS

SEQ ID NO: 3695 - protein, 14 aa, Artificial Sequence
  Synthetic
ARKSGSYYNRNFDY

SEQ ID NO: 3696 - protein, 110 aa, Artificial Sequence
  Synthetic
QSVLTQPPSVSAAPRQRVTISCSGSSSNIGNNAVNWYQRLPGKAPKLLIYYDNLLPSGVSDRFSGSKSGTSVSLAISGLQSEDEADYYCAAWDDSLNGPVFGGGTKLTVL

SEQ ID NO: 3697 - protein, 11 aa, Artificial Sequence
  Synthetic
AAWDDSLNGPV

SEQ ID NO: 3698 - protein, 112 aa, Artificial Sequence
  Synthetic
EVQLVQSGAEVKKPGESLRISCKGSGYSFITYWISWVRQMPGKGLEWMGRINPIDSHTNYSPSFQGHVTMSVDRSISTAYLLWSSLKASDTAMYYCATTYVWGQGTLVTVSS

SEQ ID NO: 3699 - protein, 5 aa, Artificial Sequence
  Synthetic
ATTYV

SEQ ID NO: 3700 - protein, 110 aa, Artificial Sequence
  Synthetic
NFMLTQPHSVSESPGKTVTISCTRSSGSIGSNYVQWYQQRPGGAPTTVISEDNQRPSGVPDRFSGSIDSSSNSASLTISGLKTEDEADYYCQSYDTSIVVFGGGTKLTVL

SEQ ID NO: 3701 - protein, 9 aa, Artificial Sequence
  Synthetic
QSYDTSIVV

SEQ ID NO: 3702 - protein, 118 aa, Artificial Sequence
  Synthetic
EVQLVESGGGLIQPGGSLRLSCAASGVIVSSNYMNWVRQTPGKGLEWVSIIYSGGSTYYAESVKGRFTISRDNSKNILYLQMKSLRAEDTAVYYCARDLFEVGGMDVWGQGTTVTVSS

SEQ ID NO: 3703 - protein, 12 aa, Artificial Sequence
  Synthetic
ARDLFEVGGMDV

SEQ ID NO: 3704 - protein, 111 aa, Artificial Sequence
  Synthetic
QSVLTQPPSASGTPGQRVTVSCSGSSSNIGSNYVYWYQQLPGTAPKLLIYSNNQRPSGVPDRFSGSKSGTSASLAISGLRSEDEADYYCAVWDDSLSADYVFGTGTKVTVL

SEQ ID NO: 3705 - protein, 12 aa, Artificial Sequence
  Synthetic
AVWDDSLSADYV

SEQ ID NO: 3706 - protein, 126 aa, Artificial Sequence
  Synthetic
QVQLQESGPGLVKPSQTLSLTCTVSGGSISSGDYYWSWIRQPPGKGLEWIGYISYSGSTYNPSLKSRATISVDTSKNKFSLKLTSVTAADTAVYYCARADENYYDSSGPGGLFDIWGQGTVVTVSS

SEQ ID NO: 3707 - protein, 19 aa, Artificial Sequence
  Synthetic
ARADENYYDSSGPGGLFDI

SEQ ID NO: 3708 - protein, 112 aa, Artificial Sequence
  Synthetic
QSVLTQPPSVSGAPGQRVTISCTGSSSNIGAGFAVHWYQQLPGTAPKLLIYGNSNRPSGVPGRFSGSKSGTSASLAITGLQVEDEAAYYCQSYDSSLSGSVVFGGGTRLTVL

SEQ ID NO: 3709 - protein, 12 aa, Artificial Sequence
  Synthetic
QSYDSSLSGSVV

SEQ ID NO: 3710 - protein, 120 aa, Artificial Sequence
  Synthetic
QVQLQESGPGLVRPSQTLSLTCTVSGGSIRSGGFYWNWIRQHPGKGLEWLGYIDYSGSTYYNPSLKSRVTISVDTSKNQLSLKLSSVTAADTAVYYCARAPYGSGFLDVWGQGTTVTVSS

SEQ ID NO: 3711 - protein, 12 aa, Artificial Sequence
  Synthetic
ARAPYGSGFLDV

SEQ ID NO: 3712 - protein, 108 aa, Artificial Sequence
  Synthetic
SYVLTQPPSVSVAPGKTARFTCGENNIGSKSVHWYQQKPGQAPVLVIYYDSDRPSGIPERFSGSNSGNTATLTISRVEAGDEADYYCQVWDGSSDRVIFGGGTKLTVL

SEQ ID NO: 3713 - protein, 11 aa, Artificial Sequence
  Synthetic
QVWDGSSDRVI

SEQ ID NO: 3714 - protein, 112 aa, Artificial Sequence
  Synthetic
EVQLVQSGAEVKKPGESLRISCKGSGYSFITYWISWVRQMPGKGLEWMGRINPVDSYTNYSPSFQGHVTISADKSINTAYLQWSNVKASDTAIYYCATTYVWGQGTLVTVSS

SEQ ID NO: 3715 - protein, 5 aa, Artificial Sequence
  Synthetic
ATTYV

SEQ ID NO: 3716 - protein, 110 aa, Artificial Sequence
  Synthetic
NFMLTQPHSVSESPGKTVTISCTRSSGSIASNYVQWYQQRPGSSPTTVIFEDNQRPSGVPDRFSGSIDNSSNSASLTISGLKTEDEADYYCQSYDFNIVVFGGGTKLTVL

SEQ ID NO: 3717 - protein, 9 aa, Artificial Sequence
  Synthetic
QSYDFNIVV

SEQ ID NO: 3718 - protein, 123 aa, Artificial Sequence
  Synthetic
QVQLVQSGGEVKKPGSSVKVSCRASGGTFSSYTFSWMRQAPGQGLEWMGRIIPALGVPNYAEKFQARVTLTADKSTTTAYMELSSLRYDDTAVYYCARDRVESSGWGYWFDPWGQGTLITVSS

SEQ ID NO: 3719 - protein, 16 aa, Artificial Sequence
  Synthetic
ARDRVESSGWGYWFDP

SEQ ID NO: 3720 - protein, 110 aa, Artificial Sequence
  Synthetic
QSVLTQPPSVSGAPGQRVTISCTGSNSNIGAGYDVHWYQQLPGTAPKILIYGNNNRPSGVPDRFSGSQSDTSASLAITGLQAEDEADYYCQSYDSSLSEVFGGGTKLTVL

SEQ ID NO: 3721 - protein, 10 aa, Artificial Sequence
  Synthetic
QSYDSSLSEV

SEQ ID NO: 3722 - protein, 118 aa, Artificial Sequence
  Synthetic
QVQLVESGGGVVQPEKSLRLSCTASGFTFSSHGMQWVRQAPGKGLEWVTLISNDGSNKHYADSVKGRFTISRDNPKNTLYLQMNSLRPEDTALYYCTRVSSGGATHAWGQGTLVTVSS

SEQ ID NO: 3723 - protein, 11 aa, Artificial Sequence
  Synthetic
TRVSSGGATHA

SEQ ID NO: 3724 - protein, 106 aa, Artificial Sequence
  Synthetic
QSVLTQEPSLTVSPGGTVTLTCASSTGAVTSGYYPNWFQQKPGQAPRALIYSTLNRHSWTPARFSGSLLGGKSALTLSGVQPEDGAEYYCLFFYVATGGGTKLTVL

SEQ ID NO: 3725 - skipped

SEQ ID NO: 3726 - protein, 122 aa, Artificial Sequence
  Synthetic
EVQLVESGGGLVQPGGSLRVSCSASGFTFSHYPMHWVRQAPGKGLEYVSGLNNYGDSPYYADSVKGRFSISRDNSRNTLFLQMSSLRAEDTAVYYCVKDPGDNILTGYFDCWGQGTLVTVSS

SEQ ID NO: 3727 - protein, 15 aa, Artificial Sequence
  Synthetic
VKDPGDNILTGYFDC

SEQ ID NO: 3728 - protein, 109 aa, Artificial Sequence
  Synthetic
SYVLTQPPSVSVAPGQTARITCGGNNIGSKNVHWYRQKPGQAPVLVVYDDSDRPSGIPERFSGSNSGNTATLTISRVEAGDEADYYCQVWDSSSDHHWVFGGGTKVTVL

SEQ ID NO: 3729 - protein, 11 aa, Artificial Sequence
  Synthetic
VWDSSSDHHWV

SEQ ID NO: 3730 - protein, 123 aa, Artificial Sequence
  Synthetic
QVQLQESGPGLVKPSQTLSLTCTFSGGSISSGNYYWSWIRQPAGKGLEWIGRIYTSGNTNYSPSLKSRVTISVDTSNNQFSLKLSSVTAADTAVYYCAREMWLQFEYWYFDLWGRGTLVTVSS

SEQ ID NO: 3731 - protein, 15 aa, Artificial Sequence
  Synthetic
AREMWLQFEYWYFDL

SEQ ID NO: 3732 - protein, 110 aa, Artificial Sequence
  Synthetic
QSALTQPRSVSGSPGQSVTISCTGTSSTVGGYNYVSWYQQHPGKAPKLMIYDVSERPSGVPDRFSGSKSGNTASLTISGLQAEDEADYYCCSYAGSYTVVFGGGTKLTVL

SEQ ID NO: 3733 - protein, 10 aa, Artificial Sequence
  Synthetic
CSYAGSYTVV

SEQ ID NO: 3734 - protein, 125 aa, Artificial Sequence
  Synthetic
EVQLVESGGGLVQPGGSLRLSCSASGFNFNSYAMHWVRQAPGKGLEYVSAISSNGGSTYYADSVKGRFTISRDNSKNTLYLHMSSLRAEDTSVYYCVKGYYYESSGYYSIAFDIWGQGTMVSVSS

SEQ ID NO: 3735 - protein, 18 aa, Artificial Sequence
  Synthetic
VKGYYYESSGYYSIAFDI

SEQ ID NO: 3736 - protein, 110 aa, Artificial Sequence
  Synthetic
QSVLTQPPSASGTPGQRVTISCSGSSSNIGSNTVNWYQQLPGTAPKLLIYINNQRPSGVPDRFSGSKSGTSASLAISGLQSEDEAGYYCAAWDDSLNGWVFGGGTKVTVL

SEQ ID NO: 3737 - protein, 11 aa, Artificial Sequence
  Synthetic
AAWDDSLNGWV

SEQ ID NO: 3738 - protein, 127 aa, Artificial Sequence
  Synthetic
QVQLQESGPGLVKPSQTLSLTCTVSGGSISSGSYYWNWIRQPAGKGLEWIGRISTSGTTDYNPSLKSRVTMSVDTSKNQFSLKLNSVTAADTAVYYCATYHYDSTVYYYDDQYFQHWGQGTLVTVSS

SEQ ID NO: 3739 - protein, 19 aa, Artificial Sequence
  Synthetic
ATYHYDSTVYYYDDQYFQH

SEQ ID NO: 3740 - protein, 106 aa, Artificial Sequence
  Synthetic
SYELTQPPSVSVSPGQTARITCSGDAFPNQYAYWYQQKPGQAPVLVIYKDNERPSGIPERFSGSTSGTTVTLTISGVQAEDEADYYCQSSDSSGVVFGGGTKVTVL

SEQ ID NO: 3741 - protein, 9 aa, Artificial Sequence
  Synthetic
QSSDSSGVV

SEQ ID NO: 3742 - protein, 125 aa, Artificial Sequence
  Synthetic
QVQLVQSGAEVKKPGASVKVSCKASGYTFTNDGITWVRQAPGQGLEWMGWISGYNGYTNYAQNLQDRVIMTIDTSTSTAYMELRSLRFDDTAVYFCVRDLMGIVVVDYYNGMDVWGQGTTVTVSS

SEQ ID NO: 3743 - protein, 18 aa, Artificial Sequence
  Synthetic
VRDLMGIVVVDYYNGMDV

SEQ ID NO: 3744 - protein, 107 aa, Artificial Sequence
  Synthetic
SYELTQPSSVSVSPGQTARITCSGDVLAKKYARWFQQKPGQAPVLMIYKDNERPSGIPERFSGSSSGTTVTLTISGAQVEDEADYYCYCAPDNNHGVFGGGTKLTVL

SEQ ID NO: 3745 - protein, 10 aa, Artificial Sequence
  Synthetic
YCAPDNNHGV

SEQ ID NO: 3746 - protein, 123 aa, Artificial Sequence
  Synthetic
QVQLQESGPGLVKTLQTLSLTCTVSGGSISSGNYYWSWIRQPAGKGMEWIGRMSVSGSTNYNPSLKSRVTISVDTSKNQFSLNLRSVTAADTAVYYCARVGALYRGYDETAPFDYWGQGTLVT

SEQ ID NO: 3747 - protein, 18 aa, Artificial Sequence
  Synthetic
ARVGALYRGYDETAPFDY

SEQ ID NO: 3748 - protein, 109 aa, Artificial Sequence
  Synthetic
SYVLTQTPSVSVAPGKTARITCGGNNIGSKSVHWYQQRPGQAPVLVIYYDYDRPSGIPERFSGSNSGNTATLTISTVEAGDEADYYCQVWDSTSDHQGVFGGGTKLTVL

SEQ ID NO: 3749 - protein, 12 aa, Artificial Sequence
  Synthetic
QVWDSTSDHQGV

SEQ ID NO: 3750 - protein, 131 aa, Artificial Sequence
  Synthetic
EVQLVESGGGLVKPGRSLRLSCTSSGFTFGDYAMSWFRQTPGKGLEWVGFIRSKAYDGTTQYAASVKGRFTISRDDSKSIAYLQMNSLKTEDTAVYYCSRGVAYYDSSGYYFGFYYYFDYWGQGTLVTVSS

SEQ ID NO: 3751 - protein, 22 aa, Artificial Sequence
  Synthetic
SRGVAYYDSSGYYFGFYYYFDY

SEQ ID NO: 3752 - protein, 112 aa, Artificial Sequence
  Synthetic
QSVLTQPPSVSGAPGQRVTISCTGSSSNIGAGYDVHWYQQLPGTAPKLLISGNTNRPSGVPDRFSGSKSGTSASLAITGLQAEDEADYYCQSYDNSLSGSVVFGGGTKLTVL

SEQ ID NO: 3753 - protein, 12 aa, Artificial Sequence
  Synthetic
QSYDNSLSGSVV

SEQ ID NO: 3754 - protein, 125 aa, Artificial Sequence
  Synthetic
QVQLVQSGSELKKPGASVKVSCKASGYTFTTYAMNWVRQAPGQGLEWMGWINTNTGDPTYGQGFTGRFVFSSDTSVSTAFLQISSLKAEDTAMYYCARARSGGESYYYYYAMDVWGQGTTVTVSS

SEQ ID NO: 3755 - protein, 18 aa, Artificial Sequence
  Synthetic
ARARSGGESYYYYYAMDV

SEQ ID NO: 3756 - protein, 104 aa, Artificial Sequence
  Synthetic
SYVLTQPPSVSVAPGQTARISCGGNSIGSKSVHWYQQKPGQAPVLVVYDDSDRPSGIPERFSGSNSGNTATLTISRVEAGDEADYYCQVWDTRGVFGGGTKLTV

SEQ ID NO: 3757 - protein, 8 aa, Artificial Sequence
  Synthetic
QVWDTRGV

SEQ ID NO: 3758 - protein, 124 aa, Artificial Sequence
  Synthetic
QVQLVQSGAEVKKPGSSVKVSCKASGGTFSSYTINWVRQAPGQGLECMGRIIPLLGIANYAEKLQGRVTITADKSTSTAYMELNSLRSEDTAVYYCARLRGYSDYGAAAYFDYWGQGTLVTVSS

SEQ ID NO: 3759 - protein, 17 aa, Artificial Sequence
  Synthetic
ARLRGYSDYGAAAYFDY

SEQ ID NO: 3760 - protein, 111 aa, Artificial Sequence
  Synthetic
QSVLTQPPSVSGAPGQRVTISCTGSNSNIGAGYDVHWYQQLPGTAPKLLIYRNNNRPSGVPDRFSGSKSGTSASLAITGLQAQDEADYYCQSYDSSLSVEVFGTGTKVTVL

SEQ ID NO: 3761 - protein, 11 aa, Artificial Sequence
  Synthetic
QSYDSSLSVEV

SEQ ID NO: 3762 - protein, 121 aa, Artificial Sequence
  Synthetic
EVQLVQSGAEVKKPGESLKISCKGSGYSFTSYWTGWVRQKPGKGLEWMGIIYPGDSDTRYSPSFQGQVTISADKSISTAYLQWSSLKASDTAMYYCARRDSGSYSGYFDYWGQGTLVAVSS

SEQ ID NO: 3763 - protein, 14 aa, Artificial Sequence
  Synthetic
ARRDSGSYSGYFDY

SEQ ID NO: 3764 - protein, 110 aa, Artificial Sequence
  Synthetic
QSVLTQPPSASGTPGQRVTISCSGSSSNIGSNPVNWYQQLPGTAPKLLIYSNNQRPSGVPDRFSGSKSGTSASLAISGLQSEDEADYYCAAWDDSLNGLVFGGGTKLTVL

SEQ ID NO: 3765 - protein, 11 aa, Artificial Sequence
  Synthetic
AAWDDSLNGLV

SEQ ID NO: 3766 - protein, 120 aa, Artificial Sequence
  Synthetic
QVQLQESGPGLVKPSQTLSLTCTVSGASISSGGFYWSWIRQHPGKGLEWIGYIYYGGTTDYNPSLKSRVTISVDTSKNQFSLKLSSVTVADTAVFYCARGVYGSGWFDPWGQGTLVTVSS

SEQ ID NO: 3767 - protein, 12 aa, Artificial Sequence
  Synthetic
ARGVYGSGWFDP

SEQ ID NO: 3768 - protein, 106 aa, Artificial Sequence
  Synthetic
SYVLTQPPSVSVAPGKTARITCGGNNIGSKSVWYQQKPGQAPVLVIYYDSDRPSGIPERFFGSNSGNTATLIISRVEAADEADYYCQVWDSSSDHPVFGGGTKLTV

SEQ ID NO: 3769 - protein, 11 aa, Artificial Sequence
  Synthetic
QVWDSSSDHPV

SEQ ID NO: 3770 - protein, 121 aa, Artificial Sequence
  Synthetic
QVQLVQSGAEVKTPGASVKVSCKASGNTFISYYMHWVRQAPGQGLEWVGIIYPSSGSTSYAQKFQGRVTMTRDTSTSTVYMELSSLRSEDTAVYYCASEPSDVLTGYYKYWGQGTLVTVSS

SEQ ID NO: 3771 - protein, 14 aa, Artificial Sequence
  Synthetic
ASEPSDVLTGYYKY

SEQ ID NO: 3772 - protein, 109 aa, Artificial Sequence
  Synthetic
SYVLTQPPSVSVAPGQTARIPCGGDNIGSKNVHWYQQKPGQAPVLVVYDDSDRPSGIPERFSGSNSGNTATLTISRVEAGDEADYYCQVWDSSRDRHYVFGTGSKVTVL

SEQ ID NO: 3773 - protein, 12 aa, Artificial Sequence
  Synthetic
QVWDSSRDRHYV

SEQ ID NO: 3774 - protein, 131 aa, Artificial Sequence; identical to SEQ ID NO: 2010
  Synthetic

SEQ ID NO: 3775 - protein, 25 aa, Artificial Sequence
  Synthetic
AREGDVEGYYDFWSGYSRDRYYFDY

SEQ ID NO: 3776 - protein, 108 aa, Artificial Sequence
  Synthetic
SYVLTQPPSVSVSPGQTARITCSGDALPKQYAYWYQQKPGQAPVLVIYKDSERPSGIPERFSGSSSGTTVTLTISGVQAEDEADYYCQSADSSGTYWVFGGGTKLTVL

SEQ ID NO: 3777 - protein, 11 aa, Artificial Sequence
  Synthetic
QSADSSGTYWV

SEQ ID NO: 3778 - protein, 118 aa, Artificial Sequence
  Synthetic
EVQLVESGGGLIQPGGSLRLSCAASGVIVSRNYMNWVRQAPGKGLEWVSVIYSGGSTYYADSVKGRFIISRDNSKNTLHLQMHSLRAEDTAVYYCARDLLEVGGMDVWGQGTTVTVSS

SEQ ID NO: 3779 - protein, 12 aa, Artificial Sequence
  Synthetic
ARDLLEVGGMDV

SEQ ID NO: 3780 - protein, 110 aa, Artificial Sequence
  Synthetic
QSVLTQPPSASGTPGQRVTISCSGSSSNIGSTLYWYQQLPGTAPKLLIYSNNQRPSGVPDRFSGSKSGTSASLTISGLRSEDEADYYCATWDDSLSASYVFGTGTKVTVL

SEQ ID NO: 3781 - protein, 12 aa, Artificial Sequence
  Synthetic
ATWDDSLSASYV

SEQ ID NO: 3782 - protein, 125 aa, Artificial Sequence
  Synthetic
EVQLVESGGGLVQPGGSLRLSCAASGFTFSRYWMSWVRQAPGKGLEWVANIKQDGSDRYYVDSVKGRVTISRDNAKNSLYLQMNSLRAEDTAVYYCARAIVDIVAAGTPEWFDPWGQGTLVTVSS

SEQ ID NO: 3783 - protein, 18 aa, Artificial Sequence
  Synthetic
ARAIVDIVAAGTPEWFDP

SEQ ID NO: 3784 - protein, 106 aa, Artificial Sequence
  Synthetic
SYVLTQPPSVSLSPGQTARITCSGDTFPNQYAYWYQQKPGQAPLLVIYKDTERPSGIPERFSGSSSGTTVTLTISGVQAEDEADYYCQSADSSGVIFGGGTKLTVL

SEQ ID NO: 3785 - protein, 9 aa, Artificial Sequence
  Synthetic
QSADSSGVI

SEQ ID NO: 3786 - protein, 123 aa, Artificial Sequence
  Synthetic
QVQLQESGPGLVKPSQTLSLTCTVSGGSISSDGYYWSWIRQRPGKGLEWIGYIYYSGSTYYNPSLKSRLAISVDTSKNQFSLKLSSVTAADTAVYYCARELGPPVGNNWFDPWGQGTLVTVSS

SEQ ID NO: 3787 - protein, 15 aa, Artificial Sequence
  Synthetic
ARELGPPVGNNWFDP

SEQ ID NO: 3788 - protein, 108 aa, Artificial Sequence
  Synthetic
SYVLTQPPSVSVAPGQTARITCGGNNIGSKSVHWYQQKPGQAPVLVVHDDSDRPSGIPERFSGSNSGNTATLTISRVEAGDEADYYCQVWDGSIVFWVFGGGTKLTVL

SEQ ID NO: 3789 - protein, 11 aa, Artificial Sequence
  Synthetic
QVWDGSIVFWV

SEQ ID NO: 3790 - protein, 129 aa, Artificial Sequence
  Synthetic
EVQLVESGGNLVKVGGSLRLSCAASGFTFSKAWMSWVRQAPGKGLEWVGRIKSKTDGGTTDYAAPVKGRFSLSRDDSKNTVYLQMNSLKTEDTAVYFCATEWRGSVTLIVVEHDALDIWGQGTVVTVSS

SEQ ID NO: 3791 - protein, 20 aa, Artificial Sequence
  Synthetic
ATEWRGSVTLIVVEHDALDI

SEQ ID NO: 3792 - protein, 108 aa, Artificial Sequence
  Synthetic
DIQMTQSPSSLSASVGDRVTITCRASQIISTFLNWYQHKPGKAPKLLIYAVSSLQTGVPSRFSGSGSGTEFTLTISSLQREDFATYYCQQTYSTLWVTFGGGTRVELK

SEQ ID NO: 3793 - protein, 10 aa, Artificial Sequence
  Synthetic
QQTYSTLWVT

SEQ ID NO: 3794 - protein, 119 aa, Artificial Sequence
  Synthetic
QVQLQQSGPRLVKPSQTLSLTCAISGDSVSSNSAAWNWIRQSPSRGLEWLGRTYYRSKWYTDYAVSVKSRITINSDTSKNQFSLQLNSVTPEDTAVYYCAREGDAFDFWGQGTMVTVSS

SEQ ID NO: 3795 - protein, 9 aa, Artificial Sequence
  Synthetic
AREGDAFDF

SEQ ID NO: 3796 - protein, 108 aa, Artificial Sequence
  Synthetic
EIVMTQSPATLSVSPGERATLSCRASESVSINVAWYQQKPGQAPRLLIYGASTRATGLPARFSGSGSGTEFTLTISSLQSEDFAVYYCQQYTNWLLYTFGQGTKLEIK

SEQ ID NO: 3797 - protein, 10 aa, Artificial Sequence
  Synthetic
QQYTNWLLYT

SEQ ID NO: 3798 - protein, 115 aa, Artificial Sequence
  Synthetic
EVQLVESGGGLVQPGGSLRLSCAASGVTVSRNYMNWVRQAPGKGLQWVSVIYPGGSTFYADSVKGRFTVSRDNSKNTLYLQMNSLRPEDTAVYYCAREKPEFDLWGRGTLVTVSS

SEQ ID NO: 3799 - protein, 9 aa, Artificial Sequence
  Synthetic
AREKPEFDL

SEQ ID NO: 3800 - protein, 107 aa, Artificial Sequence
  Synthetic
DIQLTQSPSFLSASVGDRVTITCRASQGISSDLAWYQQKPGKAPRLLIYAASTLQSGVPSRFSGSGSGTDFTLTISSLQPEDFATYYCQQLNSDSYTFGQGTKLEIK

SEQ ID NO: 3801 - protein, 9 aa, Artificial Sequence
  Synthetic
QQLNSDSYT

SEQ ID NO: 3802 - protein, 117 aa, Artificial Sequence
  Synthetic
EVQLVESGGGMVQPGGSLRLSCAASGLTVSSNYMRWVRQAPGKGLEWVSLIYSGGSTYYADSVKGRFTISRDNSKNTLYLQMISLRAEDTAVYYCARDLMVRGMDVWGQGTTVIVSS

SEQ ID NO: 3803 - protein, 11 aa, Artificial Sequence
  Synthetic
ARDLMVRGMDV

SEQ ID NO: 3804 - protein, 105 aa, Artificial Sequence
  Synthetic
DIQMTQSPSSLSASVGDRVTITCRASQGISSWLAWYQQKPGTAPKLLIYAASSLYSGVPSRFSGSGSGTDFTLTISSLQPEDFATYYCQQTDDFPTFGGGTKVEI

SEQ ID NO: 3805 - protein, 8 aa, Artificial Sequence
  Synthetic
QQTDDFPT

SEQ ID NO: 3806 - protein, 117 aa, Artificial Sequence
  Synthetic
QVQLQESGPGLVKPSQTLSLSCTVSGGSISSGGYYWSWIRQHPEKGLEWIGNIYYTGTTYYNPSLKSRVSISVDTSKNHFSLRLSSVTAADTAVYYCARALGLIDYWGQGTLVTVSS

SEQ ID NO: 3807 - protein, 9 aa, Artificial Sequence
  Synthetic
ARALGLIDY

SEQ ID NO: 3808 - protein, 108 aa, Artificial Sequence
  Synthetic
DIQMTQSPSSLSASVGDRVTITCRASQVISNSLAWYQQKPGKAPKLLLYAASTLESGVPSRFSGSGSGTDFTLTISSLQPEDFATYYCQQYYSDPPHTFGQGTKLDIK

SEQ ID NO: 3809 - protein, 10 aa, Artificial Sequence
  Synthetic
QQYYSDPPHT

SEQ ID NO: 3810 - protein, 124 aa, Artificial Sequence
  Synthetic
QVQLVESGGGVVQPGRSLRLSCAVSGFTFSRYGMHWVRQAPGKGLEWVTLISYDGSDKYYADSVRGRFTISRDNSKNTVYLQMNSLRAEDTAVYYCAKGPWYSSGWYENGFDYWGQGTLVTVSS

SEQ ID NO: 3811 - protein, 17 aa, Artificial Sequence
  Synthetic
AKGPWYSSGWYENGFDY

SEQ ID NO: 3812 - protein, 108 aa, Artificial Sequence
  Synthetic
DIQMTQSPSSLSASVGDRVTFTCQASQDIRNYLNWYQRNPGKAPNLLIYDASNLETGVPSRFSGGGSGTDFSFTISSLQPEDIATYSCQHYDNLPRITFGQGTRLEIK

SEQ ID NO: 3813 - protein, 10 aa, Artificial Sequence
  Synthetic
QHYDNLPRIT

SEQ ID NO: 3814 - protein, 117 aa, Artificial Sequence
  Synthetic
EVQLVESGGGLVQPGGSLRLSCAASGFIVSSNYMSWVRQPPGKGLEWVSVIYPGGSTFYADSVKGRFTISRDNSKNTLYHQMNSLRAEDTAVYYCVRDWGEFYFDYWGQGTLVTVSS

SEQ ID NO: 3815 - protein, 11 aa, Artificial Sequence
  Synthetic
VRDWGEFYFDY

SEQ ID NO: 3816 - protein, 107 aa, Artificial Sequence
  Synthetic
EIVLTQSPGTLSLSPGERATLSCRASQSVSSSFLAWYQQKPGQAPRLLIYGASSRATGIPDRFSGSGSGTDFTLTISRLEPEDFAVYSCQQYGTSPRTFGQGTKLEI

SEQ ID NO: 3817 - protein, 9 aa, Artificial Sequence
  Synthetic
QQYGTSPRT

SEQ ID NO: 3818 - protein, 123 aa, Artificial Sequence
  Synthetic
QVQLVESGGGVVQPGRSLRLSCAASGFTFSNYGMHWVRQAPGKGLEWVAVISYDGSDKYYADSVKGRFTISRDNSKNTLFLQMNSLRAEDTAIYYCAKGIYSYGLLQTYFDYWGQGTPVTVSS

SEQ ID NO: 3819 - protein, 16 aa, Artificial Sequence
  Synthetic
AKGIYSYGLLQTYFDY

SEQ ID NO: 3820 - protein, 107 aa, Artificial Sequence
  Synthetic
DIQMTQSPSSLSASVGDRVTITCQASEDIGNYLNWYQQEQGKAPKVLIYDASNLEIGVPSRFSGRGSGTDFTFTISSLQPEDIATYYCQQYHSLPLKFGGGTKLEIK

SEQ ID NO: 3821 - protein, 9 aa, Artificial Sequence
  Synthetic
QQYHSLPLK

SEQ ID NO: 3822 - protein, 121 aa, Artificial Sequence
  Synthetic
QVQLVESGGGVVQPGRSLRLSCAASGFTFSNYGMHWVRQAPGKGLEWVAVISDDGSMKFYADSVKGRFTISRDNSKNTLFLQMNSLRAEDTAMYYCARDWGPSMVTLFDYWGQGTLVTVSS

SEQ ID NO: 3823 - protein, 14 aa, Artificial Sequence
  Synthetic
ARDWGPSMVTLFDY

SEQ ID NO: 3824 - protein, 108 aa, Artificial Sequence
  Synthetic
DIQMTQSPSSLSASVGDRVTITCRASQSISTYLNWYRQKPGKAPKLLIYTASSLQSGVPSRFSGSGSGTDFTLTISSLQPEDFATYYCQQSYNTPPWTFGQGTKVEIK

SEQ ID NO: 3825 - protein, 10 aa, Artificial Sequence
  Synthetic
QQSYNTPPWT

SEQ ID NO: 3826 - protein, 126 aa, Artificial Sequence
  Synthetic
EVQLVQSGAEVKKPGESLKISCKGSGYSFTKYWIGWVRQMPGKGLEWMGIIYPGDSDTRYSPSLQGQVTISADKSISTAYLQWDSLKVSDTAMYYCVREGEGFDILTAYYIPPQHWGQGTLVTVSS

SEQ ID NO: 3827 - protein, 19 aa, Artificial Sequence
  Synthetic
VREGEGFDILTAYYIPPQH

SEQ ID NO: 3828 - protein, 108 aa, Artificial Sequence
  Synthetic
EIVMTQSPATLSVSPGERATLSCRASQSVTYNLAWYQQKPGQAPRLLIYGVSTRATGIPARFSGSGSGTEFTLTISSLQSEDFAVYYCQQYNNWPLWTFGQGTKVEIK

SEQ ID NO: 3829 - protein, 10 aa, Artificial Sequence
  Synthetic
QQYNNWPLWT

SEQ ID NO: 3830 - protein, 126 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGSYYWYNWNSYYYGMDVWGQGTTVTVSS

SEQ ID NO: 3831 - protein, 19 aa, Artificial Sequence
  Synthetic
AKGSYYWYNWNSYYYGMDV

SEQ ID NO: 3832 - protein, 108 aa, Artificial Sequence
  Synthetic
EIVLTQSPATLSLSPGERATLSCGASQSVSSSYLAWYQQKPGLAPRLLIYDASSRATGIPDRFSGSGSGTDFTLTISRLEPEDFAVYYCQQYGSSSLTFGGGTKVEIK

SEQ ID NO: 3833 - protein, 9 aa, Artificial Sequence
  Synthetic
QQYGSSSLT

SEQ ID NO: 3834 - protein, 122 aa, Artificial Sequence
  Synthetic
EVQLVESGGGLVQPGGSLRLSCSASGFTFSNFAMHWVRQAPGKGLEYVSAIGSNGGSTYYADSVKGRFTISRDNSKNTLHLQMSSLRAEDTAVYYCVKDKENSAMVDYFDSWGQGTLVTVSS

SEQ ID NO: 3835 - protein, 15 aa, Artificial Sequence
  Synthetic
VKDKENSAMVDYFDS

SEQ ID NO: 3836 - protein, 107 aa, Artificial Sequence
  Synthetic
DIQMTQSPSSLSAFVGDRVTITCRASQSISRYLNWYRQKPGKAPKLLIYAASSLQNGVPSRFSGSGSGTDFTLTISSLQPEDFATYYCQQSYSTPGTFGQGTKLEIK

SEQ ID NO: 3837 - protein, 9 aa, Artificial Sequence
  Synthetic
QQSYSTPGT

SEQ ID NO: 3838 - protein, 123 aa, Artificial Sequence
  Synthetic
EVQLVESGGGLVQPGGSLRLSCAASGFTFSSYNMNWVRQAPGKGLEWVSYISSSSSTIYYADSVKGRFTISRDNAKNSLYLQMNSLRDDDTAVYYCARVLGPTSYYYYGMDVWGQGTTVTVSS

SEQ ID NO: 3839 - protein, 16 aa, Artificial Sequence
  Synthetic
ARVLGPTSYYYYGMDV

SEQ ID NO: 3840 - protein, 107 aa, Artificial Sequence
  Synthetic
DIQMTQSPSSLSASVGDRVTITCRASQDIHSYLSWYQQKPGKAPKLLIYGASSLQSGVPSRFSGSGSGTDFTLTISSLQPEDFATYYCQQSYSTPVTFGQGTKLEIK

SEQ ID NO: 3841 - protein, 9 aa, Artificial Sequence
  Synthetic
QQSYSTPVT

SEQ ID NO: 3842 - protein, 117 aa, Artificial Sequence
  Synthetic
QLQLQESGPRLVKPSETLSLTCTVSGGSISSSNYYWGWIRQTPGKGLEWIGSINNSGSTYYNPSLKSRVTISVDTSKNQFSLKLNTVTATETAVYYCARQLGLIDYWGQGILVTVSS

SEQ ID NO: 3843 - protein, 9 aa, Artificial Sequence
  Synthetic
ARQLGLIDY

SEQ ID NO: 3844 - protein, 108 aa, Artificial Sequence
  Synthetic
DIQMTQSPSSLATSVGDRVTITCRASQGISNSLAWYQQRPGKAPKLLLYAASTLESGVPSRFSGSGSGTDFTLTISSLQPEDFATYYCQQYYSPPPYTFGQGTKLEIK

SEQ ID NO: 3845 - protein, 10 aa, Artificial Sequence
  Synthetic
QQYYSPPPYT

SEQ ID NO: 3846 - protein, 117 aa, Artificial Sequence
  Synthetic
EVQLVESGGGLIQPGGSLRLSCAASGVTVSRNYMSWVRQAPGKGLEWVSVIYSGGSTFYTDSVKGRFTISRDNSRNTLFLQMNSLRAEDTAVYYCARDRFEGAFDIWGQGTMVTVSS

SEQ ID NO: 3847 - protein, 11 aa, Artificial Sequence
  Synthetic
ARDRFEGAFDI

SEQ ID NO: 3848 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPSITFGHGTRLEIK

SEQ ID NO: 3849 - protein, 10 aa, Artificial Sequence
  Synthetic
QQLNSYPSIT

SEQ ID NO: 3850 - protein, 123 aa, Artificial Sequence
  Synthetic
EVQLLESGGGLVQPGGSLRLSCAASGFTFSSFPMNWVRQAPGKGLEWVAGISGSGDITNYADSVKGRFSISRDNSKNTLYLQMNSLRVEDTALYYCAKDASDYNDYVEWFDPWGQGTLVTVSS

SEQ ID NO: 3851 - protein, 16 aa, Artificial Sequence
  Synthetic
AKDASDYNDYVEWFDP

SEQ ID NO: 3852 - protein, 108 aa, Artificial Sequence
  Synthetic
DIQMTQSPSSLSASVGDRVTITCRASQSIGRYLNWYQQRPGKAPRLLIYAASTLQSGVPSRFSGSGSATDFTLTISSLQPEDFATYYCQQSYSSSPYTFGQGTKLQIK

SEQ ID NO: 3853 - protein, 10 aa, Artificial Sequence
  Synthetic
QQSYSSSPYT

SEQ ID NO: 3854 - protein, 117 aa, Artificial Sequence
  Synthetic
EVQLVESGGGLVQPGGSLRLSCAASGFIVSRNYMSWVRQAPGKGLEWVSVIYSGGSTFYTDSVKGRFTISRDSSKNTLYLHMNSLRGEDTAVYYCTRMYGDLYFDYWGQGTLVTVSS

SEQ ID NO: 3855 - protein, 11 aa, Artificial Sequence
  Synthetic
TRMYGDLYFDY

SEQ ID NO: 3856 - protein, 103 aa, Artificial Sequence
  Synthetic
DIQMTQSPSTLSASVGDRVTITCRASQSIDNWLAWYQQKPGKAPKLLIYKVSSLESGVPSRFSGSGSGTEFTLTISSLQPDDFATYYCQHSMTFGQGTKVEIK

SEQ ID NO: 3857 - protein, 5 aa, Artificial Sequence
  Synthetic
QHSMT

SEQ ID NO: 3858 - protein, 116 aa, Artificial Sequence
  Synthetic
QVQLQESGPGLVKPSETLSLTCAVSGYSISSGYYWGWIRQSPGKGMEWIGSMFHSGRTYYNPSLKSRVTVSVDRSKNQFSLKLSSVTAADTAVYYCARALGAFDIWGQGTMVIVSS

SEQ ID NO: 3859 - protein, 9 aa, Artificial Sequence
  Synthetic
ARALGAFDI

SEQ ID NO: 3860 - protein, 107 aa, Artificial Sequence
  Synthetic
DIQMTQSPSSLSASVGDRVTITCRASQGISNSLAWYQQKPGKAPNLLLYAASTLESGVPSRFSGSGSGTDFTLTISSLQPEDFASYYCQQYFSAPPITFGPGTKVDI

SEQ ID NO: 3861 - protein, 10 aa, Artificial Sequence
  Synthetic
QQYFSAPPIT

SEQ ID NO: 3862 - protein, 118 aa, Artificial Sequence
  Synthetic
EVQLVETGGGLIQPGGSLRLSCAASGVTVSSNYMSWVRQAPGKGLEWVSVIYSGGSTFYADSVKGRFTISRDNSKNTLFLQMNSLRAEDTAVYYCARDLRGPGLFDLWGRGTLVTVSS

SEQ ID NO: 3863 - protein, 12 aa, Artificial Sequence
  Synthetic
ARDLRGPGLFDL

SEQ ID NO: 3864 - protein, 108 aa, Artificial Sequence
  Synthetic
DIQMTQSPSSLSASVGDRVTITCQASQDISNYLNWYQQKPGKAPKLLIYDASNLETGVSSRFSGSGSGTDFTFTISSLQPEDIATYYCQQYDNLPGVTFGPGTKVDIK

SEQ ID NO: 3865 - protein, 10 aa, Artificial Sequence
  Synthetic
QQYDNLPGVT

SEQ ID NO: 3866 - protein, 120 aa, Artificial Sequence
  Synthetic
QVQLVQSGAEVKRPGASVKVSCKASGYSFTTYGISWVRQAPGQGLEWMGWISAYNGNTNYAQKLQGRVTMTTDTSTSTAYMELKSLRSDDTAVYYCARDFGEFGVPLDYWGQGTLVIVSS

SEQ ID NO: 3867 - protein, 13 aa, Artificial Sequence
  Synthetic
ARDFGEFGVPLDY

SEQ ID NO: 3868 - protein, 108 aa, Artificial Sequence
  Synthetic
DIQMTQSPSSLSVSVGDRVTITCRASQSLSNYLNWYQQKPGEAPKLLIYAASSLQSGFPSRFSGSGSGTDFTLTISSLQPEDFATYYCQQSYGTLSITFGQGTRLEIK

SEQ ID NO: 3869 - protein, 10 aa, Artificial Sequence
  Synthetic
QQSYGTLSIT

SEQ ID NO: 3870 - protein, 116 aa, Artificial Sequence
  Synthetic
QVQLQESGPGLVKASETLSLTCAVSGYSISGGYYWGWIRQPPGKGLEWIGNIFHSGSTYYNPSLKSRVTISIDTPQNKFSLNLSSVTAADTAVYYCVRALGAFDIWGQGTMVIVSS

SEQ ID NO: 3871 - protein, 9 aa, Artificial Sequence
  Synthetic
VRALGAFDI

SEQ ID NO: 3872 - protein, 108 aa, Artificial Sequence
  Synthetic
DIQMTQSPSSLSASVGDRVTITCRASQVISNSLSWYQQRPGKAPKLLLYAASTLESGVPSRFSGSGSGTIYTLTISSLQPEDFATYYCQQYYSDPPITFGPGTKVDFK

SEQ ID NO: 3873 - protein, 10 aa, Artificial Sequence
  Synthetic
QQYYSDPPIT

SEQ ID NO: 3874 - protein, 117 aa, Artificial Sequence
  Synthetic
QVQLQESGPGLMKPSQTLSLTCTVSGGSISSGGYYWSWIRQHPGKGLEWIGCIYYSGNTYYNPSLKSRVNISLDTSKNQFSLMLSSVTAADTAVYYCARALGLIDYWGQGTLVTVSS

SEQ ID NO: 3875 - protein, 9 aa, Artificial Sequence
  Synthetic
ARALGLIDY

SEQ ID NO: 3876 - protein, 108 aa, Artificial Sequence
  Synthetic
DIQMTQSPSSLSASVGDRVTITCRASQGISNSLAWYQQKPGKAPKLLLYAASTLESGVPSRFSGNGSGTDFTLTISSLQPEDFATYYCQQYYSPPPHTFGQGTRLEIK

SEQ ID NO: 3877 - protein, 10 aa, Artificial Sequence
  Synthetic
QQYYSPPPHT

SEQ ID NO: 3878 - protein, 117 aa, Artificial Sequence
  Synthetic
QLQLQESGPGLVKPSETLSLTCTVSGGSISSSSHYWGWIRQPPGKGLEWIGSIYYSGSTYYNPSLKSRVTISVDTSKNQFSLKLTSVTAADTAVYYCARLLGLIDYWGQGTLVTVSS

SEQ ID NO: 3879 - protein, 9 aa, Artificial Sequence
  Synthetic
ARLLGLIDY

SEQ ID NO: 3880 - protein, 108 aa, Artificial Sequence
  Synthetic
DIQMTQSPSSLSASVGDRVTITCRASQGISNSLAWYQQKPGKAPKLLLYAASTLESGVPSRFSGSGSGTDFTLTISSLQPEDFATYCCQQYYSPPPHTFGQGTRLEIK

SEQ ID NO: 3881 - protein, 10 aa, Artificial Sequence
  Synthetic
QQYYSPPPHT

SEQ ID NO: 3882 - protein, 124 aa, Artificial Sequence
  Synthetic
QVQLVESGGGVVQPGRSLRLSCAASGFTFRSHAMHWVRQAPGKGLEWVALIWYDGSNKYYADSVKGRFTISRDNSKNTLYLQMNSLRAEDTAVYFCAREGIAAPGSKADAFDIWGQGTMVTVSS

SEQ ID NO: 3883 - protein, 17 aa, Artificial Sequence
  Synthetic
AREGIAAPGSKADAFDI

SEQ ID NO: 3884 - protein, 107 aa, Artificial Sequence
  Synthetic
DIQMTQSPSSLSASVGDRVTITCRASQSISTFLNWYQQKSGKAPKLLIYAASSLQSGVPSRFSGSGSGTDFSLTISSLQAEDFATYYCQQSYSTLYAFGQGTKLEIK

SEQ ID NO: 3885 - protein, 9 aa, Artificial Sequence
  Synthetic
QQSYSTLYA

SEQ ID NO: 3886 - protein, 129 aa, Artificial Sequence
  Synthetic
QVQLVESGGGVVQPGRSLRLSCAASGFTFSTYAMHWVRQAPGKGLEWVAVLSYDGTYKDYADSVKGRFTISRDNSKNTLYLQMNSLRAEDTALYFCAREGADIVTAITRIPVAGSFDYWGQGTLVTVSS

SEQ ID NO: 3887 - protein, 22 aa, Artificial Sequence
  Synthetic
AREGADIVTAITRIPVAGSFDY

SEQ ID NO: 3888 - protein, 108 aa, Artificial Sequence
  Synthetic
DIQMTQSPSSLSASVGDRVTITCRASQSISNYLNWYQQKPGKAPKLLIYAASSLQSGVPSRFSGSGSGTDFTLTISSLQPEDFATYYCQQSYSTPPWTFGQGTKVEIQ

SEQ ID NO: 3889 - protein, 10 aa, Artificial Sequence
  Synthetic
QQSYSTPPWT

SEQ ID NO: 3890 - protein, 122 aa, Artificial Sequence
  Synthetic
QVQLVESGGGVVQPGRSLRLSCAASGFTFSGYGMYWVRQAPGKGLEWVAVISYDGSDKYYANSVKGRFTISRDNSKNTLYLQMNSLRVEDTAVYYCANDRPVYYYDSSVPSWGQGTLVTVSS

SEQ ID NO: 3891 - protein, 15 aa, Artificial Sequence
  Synthetic
ANDRPVYYYDSSVPS

SEQ ID NO: 3892 - protein, 107 aa, Artificial Sequence
  Synthetic
EIVLTQSPATLSLSPGDRATLSCRASQSVSNYLAWYQQKPGQAPRLLIYDAFNRATGIPARFSGSGSGTDFTLTISSLEPEDFAVYYCQQRSNWPLTFGGGTKVEIK

SEQ ID NO: 3893 - protein, 9 aa, Artificial Sequence
  Synthetic
QQRSNWPLT

SEQ ID NO: 3894 - protein, 124 aa, Artificial Sequence
  Synthetic
QVQLVESGGGVVQPGRSLRLSCAASGFTFRSHAMHWVRQAPGKGLECVAVIWNDGSNKYYVDSVKGRFTISRDNSKNTLYLQMNSLRAEDTAVYYCAREGIAADGSKADAFDIWGQGTKVTVSS

SEQ ID NO: 3895 - protein, 17 aa, Artificial Sequence
  Synthetic
AREGIAADGSKADAFDI

SEQ ID NO: 3896 - protein, 107 aa, Artificial Sequence
  Synthetic
DIQMTQSPSSLSASVGDRVTITCRARQNINNFLNWYQQKPGKAPNLLIYAASNLESGVPSRFSGSQSGTEFTLTISSLQPEDFATYYCQESYSTLYTFGQGTKLEIK

SEQ ID NO: 3897 - protein, 9 aa, Artificial Sequence
  Synthetic
QESYSTLYT

SEQ ID NO: 3898 - protein, 122 aa, Artificial Sequence
  Synthetic
QVQLVESGGGVVQPGRSLRLSCAASGFTFSNYDMHWVRQAPGKGLDWVAVISHDGSSKFYADSVKGRFTISRDNSKNTLYLQMNSLRSEDTSVYYCAREEISMIVVGPLDVWGQGTTVTVSS

SEQ ID NO: 3899 - protein, 15 aa, Artificial Sequence
  Synthetic
AREEISMIVVGPLDV

SEQ ID NO: 3900 - protein, 107 aa, Artificial Sequence
  Synthetic
DIQMTQSPSSLSASVGDRVTITCRASQSISSYLNWYQQKPGKAPNLIYAASSLQSGVPSRFSGSGSGTDFTLTISSLQPEDFATYYCQQSYGTPPLTFGGGTKVEIK

SEQ ID NO: 3901 - protein, 10 aa, Artificial Sequence
  Synthetic
QQSYGTPPLT

SEQ ID NO: 3902 - protein, 127 aa, Artificial Sequence
  Synthetic
EVQLVQSGAEVKKPGESLKISCKGSGYSFSNYWIAWVRQMPGKGLEWMGIIYPGDSDTRYSPSFQDQVTISADKSINTAYLQWSRLKASDTAMYYCARWTSPYYYGSGSYSNEHDYWGQGTLVTVSS

SEQ ID NO: 3903 - protein, 20 aa, Artificial Sequence
  Synthetic
ARWTSPYYYGSGSYSNEHDY

SEQ ID NO: 3904 - protein, 112 aa, Artificial Sequence
  Synthetic
DIVMTQSPLSLPVTPGEPASISCRSSQSLLHSNGYNYLNWYLQKSGQSPQLLIYMGSNRASGVPDRFSGSGSGTDFTLKISRVEAEDVGVYYCMQALQTPLTFGGGTKVEIK

SEQ ID NO: 3905 - protein, 9 aa, Artificial Sequence
  Synthetic
MQALQTPLT

SEQ ID NO: 3906 - protein, 118 aa, Artificial Sequence
  Synthetic
EVQLVESGGGLVQPGGSLRLSCVGTGVTVSRNYMNWVRQAPGKGLEWVSIIYSGGSTYYADSVKGRFTISRDNSKNTLYLQMNSLRAEDTAVYYCARDIRQRGGMDVWGQGTTVTVSS

SEQ ID NO: 3907 - protein, 12 aa, Artificial Sequence
  Synthetic
ARDIRQRGGMDV

SEQ ID NO: 3908 - protein, 107 aa, Artificial Sequence
  Synthetic
DIQMTQSPSSLSASLGDRVTITCQASQDINYYLNWYQQKPGKAPKLLIYDASNLVTGVPSRFSGSGSGTDFTFTISSLQPEDIATYYCHQYEDLPPLFGQGTKLEIK

SEQ ID NO: 3909 - protein, 9 aa, Artificial Sequence
  Synthetic
HQYEDLPPL

SEQ ID NO: 3910 - protein, 122 aa, Artificial Sequence
  Synthetic
QVQLQESGPGLVKPSEILSLTCSVSGGSISSYYWSWIRQPPGKGLEWIGYIFYSGSTNYNPSLRSRVAISVDTSKNQFSLKLSSVTAADTAVYYCARDRGYDSSGPDAFDIWGQGTMVTVSS

SEQ ID NO: 3911 - protein, 16 aa, Artificial Sequence
  Synthetic
ARDRGYDSSGPDAFDI

SEQ ID NO: 3912 - protein, 106 aa, Artificial Sequence
  Synthetic
EIVLTQSPSLSLSPGERATLSCRASQSVSSYLAWYQQKPGQAPRLLIYDASNRATGIPARFSGSGSGTDFTLTISSLEPEDFAVYFCQQRSNWPGTFGQGTRLEIK

SEQ ID NO: 3913 - protein, 9 aa, Artificial Sequence
  Synthetic
QQRSNWPGT

SEQ ID NO: 3914 - protein, 122 aa, Artificial Sequence
  Synthetic
QVQLVQSGAEVKKPGASVKVSCKASGYTFTSYGISWVRQAPGQGLEWMGWISAYNANTNYAQKLQGRVTMTTDTSTRTAYMELRSLRSDDTAVYYCARDSGSSGYYYGMDVWGQGTTVTVSS

SEQ ID NO: 3915 - protein, 15 aa, Artificial Sequence
  Synthetic
ARDSGSSGYYYGMDV

SEQ ID NO: 3916 - protein, 108 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRINWPPDTFGQGTRLEIK

SEQ ID NO: 3917 - protein, 10 aa, Artificial Sequence
  Synthetic
QQRINWPPDT

SEQ ID NO: 3918 - protein, 122 aa, Artificial Sequence
  Synthetic
QVQLVQSGAQVKKPGASVNISCKAPGYTFTNHYMHWVRQAPGQGLEWMGTINPSAGSTSYAQKFQGRVTMTTDTSTSTVYMELSSLRSEDTAVYYCARDLFFIPASNAFDIWGQGTMVIVSS

SEQ ID NO: 3919 - protein, 15 aa, Artificial Sequence
  Synthetic
ARDLFFIPASNAFDI

SEQ ID NO: 3920 - protein, 107 aa, Artificial Sequence
  Synthetic
DIQMTQSPSSLSASVGDRVTITCRARQGISSWLAWYQQKAEKAPKSLIYTASSLQSGVPSSFSGNGSGTDFSLTISSLQPEDFATSYCQQYNSDPPNTFGQGTKLDI

SEQ ID NO: 3921 - protein, 10 aa, Artificial Sequence
  Synthetic
QQYNSDPPNT

SEQ ID NO: 3922 - protein, 122 aa, Artificial Sequence
  Synthetic
QVQLQESGPGLVKPSETLSLTCTVSGGSISNYYWSWIRQSPGERLEWIGYIFHSGSTNYSPSLRGRVTVSVDTSKKQFSLKLRSVTAADTAVYYCARDRGYDSSGPDAFDIWGQGTRVTVSS

SEQ ID NO: 3923 - protein, 16 aa, Artificial Sequence
  Synthetic
ARDRGYDSSGPDAFDI

SEQ ID NO: 3924 - protein, 107 aa, Artificial Sequence
  Synthetic
EIVLTQSPATLSLSPGERATLSCRASQSVSRYLAWYQQKPGQAPRLLIYDASNRATGIPARFSGSGSGTDFTLTISSLEPEDFAVYYCHQRSNWPGTFGQGTRLEIK

SEQ ID NO: 3925 - protein, 9 aa, Artificial Sequence
  Synthetic
HQRSNWPGT

SEQ ID NO: 3926 - protein, 117 aa, Artificial Sequence
  Synthetic
EVQLVESGGGLIQPGGSLRLSCAASGFTVTSNYMTWVRQTPGKGLQWVSIIYSGGSTFYADSVKGRFTISRDNSKNTLYLQMNSLRAEDTAVYYCRLTVTPRGFDYWGQGTLVTVSS

SEQ ID NO: 3927 - protein, 11 aa, Artificial Sequence
  Synthetic
RLTVTPRGFDY

SEQ ID NO: 3928 - protein, 108 aa, Artificial Sequence
  Synthetic
EIVMTQSPATLSVSPGERATLSCRASQSVSSNLAWYQQKPGQAPRLLIYGASTRANGIPARFSGGGSGTHFTLTISSLQSEDFALYYCQQYNNWPQDTFGQGTKLEIK

SEQ ID NO: 3929 - protein, 10 aa, Artificial Sequence
  Synthetic
QQYNNWPQDT

SEQ ID NO: 3930 - protein, 121 aa, Artificial Sequence
  Synthetic
QVQLQESGPGLVKPSQTLSLTCSVSGASINRGGHYWTWIRQHPGKGLEWIGYINYSGSTYYNPVLKSRVSISADTSKNQFSLRLSSVTAADTAVYYCATDRAFGELGFDYWGPGTLVTISS

SEQ ID NO: 3931 - protein, 13 aa, Artificial Sequence
  Synthetic
ATDRAFGELGFDY

SEQ ID NO: 3932 - protein, 107 aa, Artificial Sequence
  Synthetic
DIQLTQSPSFLSASVGDRVTITCRASQGISYYLAWYQQKPGKAPKLLIYAASTLHSGVPSRFSGSGSGTEFSLTISSLQPEDFATYYCQQLNSYLLTFGGGTKVEIK

SEQ ID NO: 3933 - protein, 9 aa, Artificial Sequence
  Synthetic
QQLNSYLLT

SEQ ID NO: 3934 - protein, 124 aa, Artificial Sequence
  Synthetic
QVQLVESGGGVVQPGRSLRLSCVVSGFSFRIYAMHWVRQAPGKGLECVAVIWNDGSKKYYADSVKGRFTISRDNSKNTLYLQMNSLRAEDTAVYYCAREGIAAAGSKPDAFDMWGQGTTVTASS

SEQ ID NO: 3935 - protein, 17 aa, Artificial Sequence
  Synthetic
AREGIAAAGSKPDAFDM

SEQ ID NO: 3936 - protein, 107 aa, Artificial Sequence
  Synthetic
DIQMTQSPSSLSASVGDRITITCRASQSISSYLNWYQQKVGKAPNLLIYAASSLQSGVPSRFSGSGSGTDFTLTINSLQPEDFATYYCQQSYSTLYTFGQGTKLEIK

SEQ ID NO: 3937 - protein, 9 aa, Artificial Sequence
  Synthetic
QQSYSTLYT

SEQ ID NO: 3938 - protein, 122 aa, Artificial Sequence
  Synthetic
QVQLQESGPGLVKPSETLSLTCTVSGDSISTYYWSWIRQPPGKRLEWIGYIFNSGGTNYNPSLRSRVTISVDTSKNQFSLKLNSVTAADTAVYYCARDRGYSSGWPDAFDIWGQGTMVTVSS

SEQ ID NO: 3939 - protein, 16 aa, Artificial Sequence
  Synthetic
ARDRGYSSGWPDAFDI

SEQ ID NO: 3940 - protein, 107 aa, Artificial Sequence
  Synthetic
EIVLTQSPATLSLSPGERATLSCRASQSVYSYLAWYQQKPGQAPRLLIYDASNRATGIPARFSGSGSGTDFTLTISSLDPEDFAVYYCQQHSNWPGTFGQGTKVEIK

SEQ ID NO: 3941 - protein, 9 aa, Artificial Sequence
  Synthetic
QQHSNWPGT

SEQ ID NO: 3942 - protein, 122 aa, Artificial Sequence
  Synthetic
QVQLVESGGGVVQPGRSLRLSCAASGFTFSTYGMHWVRQAPGKGLEWVAFISFDGSDKYFADSVKGRFTISRDNSKNTVFLQVNSLRAEDTAVYYCAKNIYNYAYIAYYDYWGQGALVTVSS

SEQ ID NO: 3943 - protein, 15 aa, Artificial Sequence
  Synthetic
AKNIYNYAYIAYYDY

SEQ ID NO: 3944 - protein, 105 aa, Artificial Sequence
  Synthetic
DIQMTQSPSSLSASVGDRVTIACQASQDISDHLNWYQQKPGKAPKILIYDASNLEAGVPSRFSGSGSGTDFTFTISNLQPEDIATYYCQQYDNLPQTFGQGTKVE

SEQ ID NO: 3945 - protein, 9 aa, Artificial Sequence
  Synthetic
QQYDNLPQT

SEQ ID NO: 3946 - protein, 116 aa, Artificial Sequence
  Synthetic
QVQLQESGPGLVKPSETLSLTCTVSGGSISSYYWSWIRQPPGKGLEWIGYIYYTGSTNYNPSLKSRVTMSVDTSKNQFSLRLSSVTAADTAVYYCARELGDAPMLWGQGTLVAVSS

SEQ ID NO: 3947 - protein, 10 aa, Artificial Sequence
  Synthetic
ARELGDAPML

SEQ ID NO: 3948 - protein, 107 aa, Artificial Sequence
  Synthetic
DIQMTQSPSSLSASVGDRVTITCRASQGIRNSLVWYQQKPGKAPKVLLYAASRLESGVPSRFSGSGSGTDYTLTISSLQPEDFATYYCQQYYITPNTFGQGTKLEIK

SEQ ID NO: 3949 - protein, 9 aa, Artificial Sequence
  Synthetic
QQYYITPNT

SEQ ID NO: 3950 - protein, 119 aa, Artificial Sequence
  Synthetic
QVQLQESGPGLVKPSQTLSLTCTVSGGSISSGSYYWTWIRQHPGKGLEWIGYIHYSGNTYYNPSLQSRLTISLDTSKNHFSLKLTSVTAADTAVYYCAKEGDYSWFDSWGQGTLVTVSS

SEQ ID NO: 3951 - protein, 11 aa, Artificial Sequence
  Synthetic
AKEGDYSWFDS

SEQ ID NO: 3952 - protein, 107 aa, Artificial Sequence
  Synthetic
EIVLTQSPATLSLSPGERATLSCRASQSVNRYLGWYQQKPGQAPRLLIYDASYRATGVPARFSGSGSGTDFTLTISSLEPEDFAVYYCQQRYNWPPITFGQGTRLEI

SEQ ID NO: 3953 - protein, 10 aa, Artificial Sequence
  Synthetic
QQRYNWPPIT

SEQ ID NO: 3954 - protein, 122 aa, Artificial Sequence
  Synthetic
QVQLQESGPGLVKPSQTLSLTCTVSGDSVSSGDYYWSWIRQHPGKGLEWIGYIYYSGNTYYNPSLKSRVTLSIDRSKNQFSLRLSSVTAADTAVYYCARAFTPYNSSPFDYWGQGTLVTVSS

SEQ ID NO: 3955 - protein, 14 aa, Artificial Sequence
  Synthetic
ARAFTPYNSSPFDY

SEQ ID NO: 3956 - protein, 107 aa, Artificial Sequence
  Synthetic
EIVMTQSPATLSVSPGERATLSCRASQSISSNLAWYQQKPGQAPRLLIYDASTRATGIPARFSGSGSGTEFTLTISSLQSEDFAVYYCQQYNNWPLAFGQGTKVEIK

SEQ ID NO: 3957 - protein, 9 aa, Artificial Sequence
  Synthetic
QQYNNWPLA

SEQ ID NO: 3958 - protein, 121 aa, Artificial Sequence
  Synthetic
EVQLVESGGGLVQPGGSLRLSCSASGFTFSSSVMHWVRQAPGKGPEYVSDISSNGGITYYADSVKGRFTISRDNSKNTLYLQMSSLRADDTAIYYCVKDHVATIFTVFDYWGQGTLVTVSA

SEQ ID NO: 3959 - protein, 14 aa, Artificial Sequence
  Synthetic
VKDHVATIFTVFDY

SEQ ID NO: 3960 - protein, 107 aa, Artificial Sequence
  Synthetic
DIQMTQSPSSLSASVGDRVTITCRASQSISSNLNWYQQKPGKAPKLLIYGASNLQSGVPSRFSGTGSGTDFSLTISSLRPEDFATYYCQQSYSSPPTFGQGTKVEIK

SEQ ID NO: 3961 - protein, 9 aa, Artificial Sequence
  Synthetic
QQSYSSPPT

SEQ ID NO: 3962 - protein, 122 aa, Artificial Sequence
  Synthetic
QVQLQESGPRLVKPSEILSLTCSVSGGSISNYYWSWIRQPPGKGLEWIGYVFNSGGTNYNPSLRSRVTISVDTSNNQISLKLRSVTAADTAVYYCARDRGYDTGGPDAFEIWGQGTMVTVSS

SEQ ID NO: 3963 - protein, 16 aa, Artificial Sequence
  Synthetic
ARDRGYDTGGPDAFEI

SEQ ID NO: 3964 - protein, 107 aa, Artificial Sequence
  Synthetic
EIVLTQSPATLSLSPGERATLSCRASQSVTSYLAWYQQKPGQAPRLLIYDASNRATGIPARFSGSGSGTDFTLTISSLEPEDFAVYFCQQRYNWPGTFGQGTRLEIK

SEQ ID NO: 3965 - protein, 9 aa, Artificial Sequence
  Synthetic
QQRYNWPGT

SEQ ID NO: 3966 - protein, 121 aa, Artificial Sequence
  Synthetic
QVQLVQSGAEVKKPGASVKVSCKASGYTFTNYYMHWVRQAPGQGLEWMGIINPSGGSTTYTQRFQGRVTMTRDTSTSTVYMALSSLRSEDTAVYYCARGGVPPHAGDFDSWGQGTLVTVSS

SEQ ID NO: 3967 - protein, 14 aa, Artificial Sequence
  Synthetic
ARGGVPPHAGDFDS

SEQ ID NO: 3968 - protein, 109 aa, Artificial Sequence
  Synthetic
EIVLTQSPGTLSLSPGERASLSCRASQSVSSSYLAWYQQKPGQAPRLLIYGASSRATGIPDRFSGSGSGTDFTLTISRLEPEDFAVYYCQQYGSSPMYTFGQGTKLEIK

SEQ ID NO: 3969 - protein, 10 aa, Artificial Sequence
  Synthetic
QQYGSSPMYT

SEQ ID NO: 3970 - protein, 124 aa, Artificial Sequence
  Synthetic
QVQLVESGGGVVQPGRSLRLSCAASGFTFRSHAMHWVRQAPGKGLEWVAVIWYDGSNKYYVDSVKGRFTISRDNSKSTLYMQMNSLRAEDTAVYYCAREGIAAAGSKADAFDIWGQGTMVTVSS

SEQ ID NO: 3971 - protein, 17 aa, Artificial Sequence
  Synthetic
AREGIAAAGSKADAFDI

SEQ ID NO: 3972 - protein, 107 aa, Artificial Sequence
  Synthetic
DIQMTQSPSSLSASVGDRVTITCRASQSISSFLNWYQQKPGEAPKLLIYAASSLQTGVPSRFSGSGSGTDFTLTISSLQPEDFATYYCQQSYSTLYTFGQGTKLEIK

SEQ ID NO: 3973 - protein, 9 aa, Artificial Sequence
  Synthetic
QQSYSTLYT

SEQ ID NO: 3974 - protein, 117 aa, Artificial Sequence
  Synthetic
QVQLQESGPGLVKPSQTLSLTCNVSGGSISSGGYFWSWIRQHPGKGLEWIGNIYYSGSTYFNPSLKSRVSISVDTSKNQFSLKLTSVTAADTAVYYCARALGLIDYWGQGTLVTVSS

SEQ ID NO: 3975 - protein, 9 aa, Artificial Sequence
  Synthetic
ARALGLIDY

SEQ ID NO: 3976 - protein, 108 aa, Artificial Sequence
  Synthetic
DIQMTQSPSSLSASVGDRVTITCRASQVISNSLAWYQQKPGKAPKLLLYAASTLESGVPSRFSGSGSGTDFTLTISSLQPEDFATYYCQQYYSTPPHTFGQGTKLEIK

SEQ ID NO: 3977 - protein, 10 aa, Artificial Sequence
  Synthetic
QQYYSTPPHT

SEQ ID NO: 3978 - protein, 127 aa, Artificial Sequence
  Synthetic
QVQLVESGGGVVQPGRSLRLSCAASGFTFRTYGMHWVRQAPGKGLEWVAVISYDGSKKYYGDSVRGRFTISRDNSKNTLYLQMNSLRAEDTAVYYCAKQGGPYCSGGNCNVGYFDYWGQGTLVTFSS

SEQ ID NO: 3979 - protein, 20 aa, Artificial Sequence
  Synthetic
AKQGGPYCSGGNCNVGYFDY

SEQ ID NO: 3980 - protein, 107 aa, Artificial Sequence
  Synthetic
DIQMTQSPSSLSASVGDRVTITCQASQDISNYLNWYQQKPGKAPKFLIYDASNLETGVSSRFSGSGSGTDFTFTISSLQPEDIGTYYCQQYDNLPLTFGGGTKVEIK

SEQ ID NO: 3981 - protein, 9 aa, Artificial Sequence
  Synthetic
QQYDNLPLT

SEQ ID NO: 3982 - protein, 122 aa, Artificial Sequence
  Synthetic
QVQLVQSGAEVKKPGASVKVSCKASADTFTNNYIHWVRQAPGQGLEWMGIINPSGGSTTYAQKFQGRVTMTGDTSTGTVYMELSSLKSEDTAVYYCARGGHIPYVRGAFDYWGQGTLVTVSS

SEQ ID NO: 3983 - protein, 15 aa, Artificial Sequence
  Synthetic
ARGGHIPYVRGAFDY

SEQ ID NO: 3984 - protein, 107 aa, Artificial Sequence
  Synthetic
EIVLTQSPGTLFLSPGERATLSCRASQSVSSTYFAWYQQKLGQAPRLLIYGASSRATGIPDRFSGSGSGTDFTLTISRLEPEDFAVYYCQHYGSSPAFGQGTKVEIK

SEQ ID NO: 3985 - protein, 8 aa, Artificial Sequence
  Synthetic
QHYGSSPA

SEQ ID NO: 3986 - protein, 124 aa, Artificial Sequence
  Synthetic
QVQLVESGGGVVQPGRSLRLSCAASGFTFRLYAMHWVRQAPGKGLECVAVIWNDGSNKYYVDSVKGRFTISRDNSKNTLYLQMNSLGAEDTAVYYCAREGVAAAGSKADAFDIWGQGTMVTVSS

SEQ ID NO: 3987 - protein, 17 aa, Artificial Sequence
  Synthetic
AREGVAAAGSKADAFDI

SEQ ID NO: 3988 - protein, 107 aa, Artificial Sequence
  Synthetic
DIQMTQSPSSLSASVGDRVTITCRASQTISTYLNWYQQKPGKAPNLLIYAASSLQSGVPSRFSGSGSGTDFTFTISSLQPEDFATYYCQQSYSTLYTFGQGTKLEIK

SEQ ID NO: 3989 - protein, 9 aa, Artificial Sequence
  Synthetic
QQSYSTLYT

SEQ ID NO: 3990 - protein, 124 aa, Artificial Sequence
  Synthetic
QVQLVESGGGVVQPGRSLRLSCEASRFTFRSHAMHWVRQAPGKGLEWVAVIWYDGKNEYYADSVKGRFTISRDNSKKMVYLQMNNLRAEDTAVYYCAREGIAAPDSKADAFDIWGQGTVVTVSS

SEQ ID NO: 3991 - protein, 17 aa, Artificial Sequence
  Synthetic
AREGIAAPDSKADAFDI

SEQ ID NO: 3992 - protein, 107 aa, Artificial Sequence
  Synthetic
DIQMTQSPSSLSASVGDRVTITCRATETISSFLNWYQHKPGKAPKLVIYAASTLQSGVPSRFSGSGSGTDFTLTISSLQPEDFATYYCQQSYSTLYSFGQGTKLEIK

SEQ ID NO: 3993 - protein, 9 aa, Artificial Sequence
  Synthetic
QQSYSTLYS

SEQ ID NO: 3994 - protein, 117 aa, Artificial Sequence
  Synthetic
EVQLVESGGGLIQPGGSLRLSCAASGLTVSSNYMNWVRQPPGKGLEWVSMIYAGGSTFYADSVKGRFTISRDNSKNTLYLQMNSLRAEDTAVYYCARDLVEYGMDVWGQGTTVTVSS

SEQ ID NO: 3995 - protein, 11 aa, Artificial Sequence
  Synthetic
ARDLVEYGMDV

SEQ ID NO: 3996 - protein, 108 aa, Artificial Sequence
  Synthetic
DIQLTQSPSFLSASVGDRVTITCRASQGISTYLAWYQQKPGKAPKLLIYAASSLQSGVPSRFSGSGSGTDFTLTISSLQPEDFATYYCQQLNSYPPETFGQGTKVEIK

SEQ ID NO: 3997 - protein, 10 aa, Artificial Sequence
  Synthetic
QQLNSYPPET

SEQ ID NO: 3998 - protein, 117 aa, Artificial Sequence
  Synthetic
QLQLQESGPRLVKPSETLSLTCTVSGGSISSSRYYWGWIRQPPGKGLEWIGSIFYTGSTYYNPSLKSRVNISVDTSKNQFSLRVSSVTAADTAVYYCARLLGASDFWGQGTLVTVSS

SEQ ID NO: 3999 - protein, 9 aa, Artificial Sequence
  Synthetic
ARLLGASDF

SEQ ID NO: 4000 - protein, 108 aa, Artificial Sequence
  Synthetic
DIQMTQSPSSLSASVGDRVTITCRASQAISNSLAWYQQKAGKAPKLLLYTASTLESGVPSRFSGSGSGADYTLTISNLQPEDFATYYCQQYYSALVLTFGGGTKVEIK

SEQ ID NO: 4001 - protein, 10 aa, Artificial Sequence
  Synthetic
QQYYSALVLT

SEQ ID NO: 4002 - protein, 124 aa, Artificial Sequence
  Synthetic
QVQLVESGGGVVQPGRSLRLSCAASGFTFRTYAMHWVRQAPGKGLEWLTVIWSAGSNKHYADSVKGRFTISRDNSKNTLYLQMNSLRAEDTAVYYCVREGIAAPDSKADAFDIWGQGTMVTVSS

SEQ ID NO: 4003 - protein, 17 aa, Artificial Sequence
  Synthetic
VREGIAAPDSKADAFDI

SEQ ID NO: 4004 - protein, 107 aa, Artificial Sequence
  Synthetic
DIQMTQSPSSLSASVGDRVTITCRASQSISSFLNWYQHKPGKAPKLLIYAASSLQSGVPSRFSGSGSGSDFTLTISSLQPEDFATYYCQQSYGTLYTFGQGTKLEIK

SEQ ID NO: 4005 - protein, 9 aa, Artificial Sequence
  Synthetic
QQSYGTLYT

SEQ ID NO: 4006 - protein, 118 aa, Artificial Sequence
  Synthetic
EVQLVESGGGLVQRGGSLRLSCVASGLTVSSNYMNWVRQAPGKGLEWVSLVYAGGSTYYADSVQGRFTVSRDNSKNTLYLQMNSLRADDTAVYYCARDIRQRGGMDVWGQGTTVTVSS

SEQ ID NO: 4007 - protein, 12 aa, Artificial Sequence
  Synthetic
ARDIRQRGGMDV

SEQ ID NO: 4008 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCHQYENIPPLFGQGTKLEIK

SEQ ID NO: 4009 - protein, 9 aa, Artificial Sequence
  Synthetic
HQYENIPPL

SEQ ID NO: 4010 - protein, 117 aa, Artificial Sequence
  Synthetic
EVQLVESGGRLIQPGGSLRLSCAASGVIVRSNYMTWVRQSPGKGLEWVSVIYSGGSTFYADSVKGRFTISRDNSKNTLYLQMNSLRDEDTAIYYCARDRFEGAFDIWGQGTMVTVSS

SEQ ID NO: 4011 - protein, 11 aa, Artificial Sequence
  Synthetic
ARDRFEGAFDI

SEQ ID NO: 4012 - protein, 108 aa, Artificial Sequence
  Synthetic
DIQLTQSPSFLSASVGDRLTITCRASQGISYYLAWYQQKPGQAPKLLIYAASTLQSGVPSRFSGSGSGTEFTLTISSLQPEDFATYYCQQLNSYPSITFGQGTRLEIK

SEQ ID NO: 4013 - protein, 10 aa, Artificial Sequence
  Synthetic
QQLNSYPSIT

SEQ ID NO: 4014 - protein, 116 aa, Artificial Sequence
  Synthetic
QVQLQESGPGLVKPSTLSLTCTVCGVSINSGDYWGSRIRQHPGKGEWIAYMDSGNTYYKESLQSVTMSIDCKNQFCLKLSVNAADTAVYYCARAFRPYNSRPFDYRGQGTLVTVSS

SEQ ID NO: 4015 - protein, 14 aa, Artificial Sequence
  Synthetic
ARAFRPYNSRPFDY

SEQ ID NO: 4016 - protein, 107 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNWPLAFGQGTKVEIK

SEQ ID NO: 4017 - protein, 9 aa, Artificial Sequence
  Synthetic
QQYNNWPLA

SEQ ID NO: 4018 - protein, 122 aa, Artificial Sequence
  Synthetic
QVQLQESGPGLVKPSQTLSLTCTVSGGSINSGDYYWSWIRQHPGKGLEWIGYIYYSGNTYYNPSLKSRVTISIDTSKNQFSLKLSSVTAADTAVYYCARAFTPYNSSPFDYWGQGTLVTVSS

SEQ ID NO: 4019 - protein, 14 aa, Artificial Sequence
  Synthetic
ARAFTPYNSSPFDY

SEQ ID NO: 4020 - protein, 107 aa, Artificial Sequence
  Synthetic
EIVMTQSPATLSVSPGERATLSCRASQSVSSNLAWYQQKPGQAPRLLIYDASTRATGIPARFSGSGSGTEFTLTISSLQSEDFAIYYCQQYNNWPLAFGQGTKVEIK

SEQ ID NO: 4021 - protein, 9 aa, Artificial Sequence
  Synthetic
QQYNNWPLA

SEQ ID NO: 4022 - protein, 122 aa, Artificial Sequence
  Synthetic
QVQLVQSGAEVKKPGASVKVSCKASGYIFTNHYIHWVRQAPGQGLEWMGIINPDGGSISYAQKFQGRVTMTRDTSTSTVYMELSSLRSEDTAVYYCARDHVVIPAAIGSDYWGQGTLVTVSS

SEQ ID NO: 4023 - protein, 15 aa, Artificial Sequence
  Synthetic
ARDHVVIPAAIGSDY

SEQ ID NO: 4024 - protein, 109 aa, Artificial Sequence
  Synthetic
EIVLTQSPATLSLSPGERATLSCRASQSVSNYLAWYQQKPGQAPRLLIYDASTRATDIPARFSGSGSGTDFTLTISSLEPEDFGIYYCQQRSNWPREFTFGPGTKVDIK

SEQ ID NO: 4025 - protein, 11 aa, Artificial Sequence
  Synthetic
QQRSNWPREFT

SEQ ID NO: 4026 - protein, 121 aa, Artificial Sequence
  Synthetic
QVQLQESGPGLVKPSQTLSLTCSVSGGSISSGGYYWNWIRQHPGKGLEWIGSIYYSGSTYYNPSLKSRVTVSVDTSKNQFSLKLNSVTAADTAVYYCARDYGGNANYFDYWGQGTLVTVSS

SEQ ID NO: 4027 - protein, 13 aa, Artificial Sequence
  Synthetic
ARDYGGNANYFDY

SEQ ID NO: 4028 - protein, 107 aa, Artificial Sequence
  Synthetic
DIQMTQSPSSLSASVGDRVTITCQASQDISKYLTWYQQKPGKAPKLLIYDASNLEAGVPSRFSGSGSGTDFSFTISYLQPEDLATYYCQQYGYLPLTFGGGTKVEMK

SEQ ID NO: 4029 - protein, 9 aa, Artificial Sequence
  Synthetic
QQYGYLPLT

SEQ ID NO: 4030 - protein, 121 aa, Artificial Sequence
  Synthetic
EVQLVQSGAEVKKPGESLRISCKGSGYTFTNYWIGWVRQMPGKGLEWMGIIYCGDSDTRYSPSFQGQVTISADKSLSTAYLQWSSLKASDTAIYYCATLQYGYSYGLFDSWGQGTLVTVSS

SEQ ID NO: 4031 - protein, 14 aa, Artificial Sequence
  Synthetic
ATLQYGYSYGLFDS

SEQ ID NO: 4032 - protein, 113 aa, Artificial Sequence
  Synthetic
DIVMTQSPDSLAVSLGERATINCKSSQSVLYSSNNKKYLAWYQQKPGQPPKLLIYWASTRESGVPDRFSGSGSGTDFTLTVSSLQAEDVAVYYCQQYYTSPWTFGQGTKVEIK

SEQ ID NO: 4033 - protein, 9 aa, Artificial Sequence
  Synthetic
QQYYTSPWT

SEQ ID NO: 4034 - protein, 119 aa, Artificial Sequence
  Synthetic
EVQLVESGGGLVQPGGSLRLSCAASGLTVSSNYMSWVRQAPGKGLEWVSVIYSGGSTYYANSVKGRFTISRDNSKNTLHLQMNSLRVEDTAVYYCARDHITMIAGTDSWGQGTLVTVSS

SEQ ID NO: 4035 - protein, 13 aa, Artificial Sequence
  Synthetic
ARDHITMIAGTDS

SEQ ID NO: 4036 - protein, 107 aa, Artificial Sequence
  Synthetic
DIQMTQSPSSLSASVGDRVTITCQASQDINNYLNWYQQKPGKAPKLLIYDASNLETGVPSRFSGSGSGTDFTFTISSLQPEDIAAYYCQQYDNLPRTFGGGTKVEIK

SEQ ID NO: 4037 - protein, 9 aa, Artificial Sequence
  Synthetic
QQYDNLPRT

SEQ ID NO: 4038 - protein, 124 aa, Artificial Sequence
  Synthetic
QVQLVESGGGVVQPGRSLRLSCAASGFTFRLHAMHWIRQAPGKGLEWVADIWYDGNNKYYADSVKGRFTISRDNSKNTLHLQMNSLRAEDTAVYYCAREGIAADGSKADAFDIWGQGTTVTVSS

SEQ ID NO: 4039 - protein, 17 aa, Artificial Sequence
  Synthetic
AREGIAADGSKADAFDI

SEQ ID NO: 4040 - protein, 107 aa, Artificial Sequence
  Synthetic
DIQMTQSPSSLSASVGDRVTITCRASQSISSFLNWYQQKPGIAPELLIYAASSLESGVPSRFSGSGSGTDFTLTISSLQPEDFATYYCQQSYSTLYTFGQGTKLEIK

SEQ ID NO: 4041 - protein, 9 aa, Artificial Sequence
  Synthetic
QQSYSTLYT

SEQ ID NO: 4042 - protein, 125 aa, Artificial Sequence
  Synthetic
QVQLVQSGAEVKRPGSSVKVSCKASGGTFTTYTISWVRQAPGQGLKWLGRIIPILGIANYAQNFQGRVTITADKSTSTAYMELSSLRSEDTAVYYCAKSDLDIVTSIEKSFFDYWGQGTLVTVSS

SEQ ID NO: 4043 - protein, 18 aa, Artificial Sequence
  Synthetic
AKSDLDIVTSIEKSFFDY

SEQ ID NO: 4044 - protein, 108 aa, Artificial Sequence
  Synthetic
EIVLTQSPATLSLSPGERATLSCRASQSVSSFLAWYQHKPGQGPRLLIYDASKRATGIPARFSGSGSGTDFTLTISSLEPEDFAVYYCQQRSDWRDATFGQGTKVEIK

SEQ ID NO: 4045 - protein, 10 aa, Artificial Sequence
  Synthetic
QQRSDWRDAT

SEQ ID NO: 4046 - protein, 117 aa, Artificial Sequence
  Synthetic
EVQLVESGGGLIQPGGSLRLSCAASGVTVSSNYMTWVRQAPGKGLEWVSVIYSGGSTFYADSVKGRFTISRDNSKNTLYLQMNSLRAEDTAVYYCARDLYYYGMDVWGQGTTVTVSS

SEQ ID NO: 4047 - protein, 11 aa, Artificial Sequence
  Synthetic
ARDLYYYGMDV

SEQ ID NO: 4048 - protein, 106 aa, Artificial Sequence
  Synthetic
DIQLTQSPSFLSASVGDRVTITCRASQGISTYLAWYQQKPGKAPKLLIYAATTLQSGVPSRFSGSGSGTEFTLTISSLQPEDFATYYCQELNSYPLFGPGTKVDIK

SEQ ID NO: 4049 - protein, 8 aa, Artificial Sequence
  Synthetic
QELNSYPL

SEQ ID NO: 4050 - protein, 124 aa, Artificial Sequence
  Synthetic
QVQLVESGGGVVQPGGSLRLSCAASGFTLRLYAMHWVRQAPGKGLECVAVIWNDGSKKYYADSVKGRFTISRDNSKNTLYLQMNSLKAGDTAVYYCAREGIAAADSKADAFDIWGQGAMVTVSS

SEQ ID NO: 4051 - protein, 17 aa, Artificial Sequence
  Synthetic
AREGIAAADSKADAFDI

SEQ ID NO: 4052 - protein, 107 aa, Artificial Sequence
  Synthetic
DIQMTQSPSSLSASVGDRVTITCRASQSISTFLNWYQQKPGKAPKLLIYAASSLQSGVPSRFSGSGSGTDFTLTISSLQPEDFATYYCQQSYSTLYTFGQGTKVEIK

SEQ ID NO: 4053 - protein, 9 aa, Artificial Sequence
  Synthetic
QQSYSTLYT

SEQ ID NO: 4054 - protein, 124 aa, Artificial Sequence
  Synthetic
QVQLVESGGGVVQPGRSLRLSCAASGFTFGLCAMHWVRQAPGKGLEWVAVIWYNGSNKYYADSVKGRFTISRDNSKNTLHLQMNSLRAEDTAVYYCAREGIAADGFKPDAFDFWGQGTMVTVSS

SEQ ID NO: 4055 - protein, 17 aa, Artificial Sequence
  Synthetic
AREGIAADGFKPDAFDF

SEQ ID NO: 4056 - protein, 107 aa, Artificial Sequence
  Synthetic
DIQMTQSPSSLSASVGDRVTITCRASQSISTFLNWYQQKPGKAPNLLIYAASSLQSEVPSRFSGSGSGTDFTLTISSLQPEDFATYYCQQSYSTLYTFGQGTKLEIK

SEQ ID NO: 4057 - protein, 9 aa, Artificial Sequence
  Synthetic
QQSYSTLYT

SEQ ID NO: 4058 - protein, 128 aa, Artificial Sequence
  Synthetic
QVQLVQSGAEVKKPGASVKVSCKASGYTFTSYGISWVRQAPGQGLEWMGWISAYDGNTNYAQKFQGRVTMTTDTSTSTVNMELRSLRFDDTAVYYCARVVDYYDSSGYSGSSYYFDYWGQGTLVTVSS

SEQ ID NO: 4059 - protein, 21 aa, Artificial Sequence
  Synthetic
ARVVDYYDSSGYSGSSYYFDY

SEQ ID NO: 4060 - protein, 109 aa, Artificial Sequence
  Synthetic
EIVMTQSPATLSVSPGERATLSCRASQSISNNLAWYQQKPGQAPRLLIYGASTRATGFPARFSGSGSGTEFTLTISSLQSEDFAVYYCQQYNNWPPEFTFGPGTKVDIK

SEQ ID NO: 4061 - protein, 11 aa, Artificial Sequence
  Synthetic
QQYNNWPPEFT

SEQ ID NO: 4062 - protein, 116 aa, Artificial Sequence
  Synthetic
QVQLQESGPGLVKPSETLSLTCAVSGYSISSGYYWGWIRQPPGKGLEWIGSIFHSGTTYYNPSLKSRVTISIDTSKNQFSLRLSSVTAADTALYYCARALGAFDIWGQGTMVTVSS

SEQ ID NO: 4063 - protein, 9 aa, Artificial Sequence
  Synthetic
ARALGAFDI

SEQ ID NO: 4064 - protein, 108 aa, Artificial Sequence
  Synthetic
DIQMTQSPSSLSASVGDRVTITCRASQGISNSLAWYQQKPGKAPKLLLYAASTLESGVPSRFSGSGSGTDYTLTISSLQPEDFASYYCQQYYSPPPITFGPGTKVDIK

SEQ ID NO: 4065 - protein, 10 aa, Artificial Sequence
  Synthetic
QQYYSPPPIT

SEQ ID NO: 4066 - protein, 117 aa, Artificial Sequence
  Synthetic
QLQLQESGPGLVKPSETLSLTCTVSGDSVSSSGYYWGWIRQSPGKGLEWIGSLYYSGSTYYNPSLKRRVTISVDTSKNQFSLKLSSVTAADTAVYYCARLLGLIDYWGQGILVTVSS

SEQ ID NO: 4067 - protein, 9 aa, Artificial Sequence
  Synthetic
ARLLGLIDY

SEQ ID NO: 4068 - protein, 108 aa, Artificial Sequence
  Synthetic
DIQMTQSPSSLSASVGDRVTITCRATQGISNSLAWYQQRPGKAPKLLLYAASTLESGVPSRFSGSGSGTDFTLTISSLQPEDFATYYCQQYYSSPPHTFGQGTKLEIK

SEQ ID NO: 4069 - protein, 10 aa, Artificial Sequence
  Synthetic
QQYYSSPPHT

SEQ ID NO: 4070 - protein, 131 aa, Artificial Sequence
  Synthetic
QVQLVQSGAEVKKPGASVKVSCKASGYTFISYGISWVRQAPGQGLEWMGWINGYNGNTNYAQKVQGRVTMTTDTSTSTAYMEVRSLRSDDTAVYYCARDRRHYYGSGSYWYDYYYYGMDVWGQGTTVTVSS

SEQ ID NO: 4071 - protein, 24 aa, Artificial Sequence
  Synthetic
ARDRRHYYGSGSYWYDYYYYGMDV

SEQ ID NO: 4072 - protein, 112 aa, Artificial Sequence
  Synthetic
DIVMTQTPLSSPVTLGQPASISCRSSRSLVHSDGNTSLSWLQQRPGQPPRLLIYKISNRFSGVPDRFSGSGAGTDFTLKISRVEAEDVGVYYCMQATQFRWTFGQGTKVEIK

SEQ ID NO: 4073 - protein, 9 aa, Artificial Sequence
  Synthetic
MQATQFRWT

SEQ ID NO: 4074 - protein, 122 aa, Artificial Sequence
  Synthetic
QVQLVQSGAEVKKPGASVKVSCKASGYTFTSHYIHWVRQAPGQGLEWMGIINPSGGSTTYAQKFQGRVTMTWDMSTSTVYMDLSSLRSEDTAVYYCAKDGRYIPVSGTFDYWGQGTLVTVSS

SEQ ID NO: 4075 - protein, 15 aa, Artificial Sequence
  Synthetic
AKDGRYIPVSGTFDY

SEQ ID NO: 4076 - protein, 107 aa, Artificial Sequence
  Synthetic
DIQMTQSPSTLSASVGDRVTITCRASQSISSWLAWYQQSPGKAPKLLIYKASSLESGVPSRFSGSGSGTEFTLTISSLQPDDFATYYCQQYKTYPYTFGQGTKLEIK

SEQ ID NO: 4077 - protein, 9 aa, Artificial Sequence
  Synthetic
QQYKTYPYT

SEQ ID NO: 4078 - protein, 122 aa, Artificial Sequence
  Synthetic
QVQLVQSGAEVKKPGASVKVSCKASGYTFTNYYIHWVRQAPGQGPEWMGIINPDAGSTSYAQKFQGRVTMTTDTSTNTVYMDLSSLRSEDAAVYYCARDIAVVPAAMGLDYWGQGTLVTVSS

SEQ ID NO: 4079 - protein, 15 aa, Artificial Sequence
  Synthetic
ARDIAVVPAAMGLDY

SEQ ID NO: 4080 - protein, 108 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPPFTFGPGTKVDIK

SEQ ID NO: 4081 - protein, 10 aa, Artificial Sequence
  Synthetic
QQRSNWPPFT

SEQ ID NO: 4082 - protein, 117 aa, Artificial Sequence
  Synthetic
EVQLVESGGGLIQPGGSLRLSCAASGLIVSSNYMSWVRQAPGKGLEWVSIIYSGGSTFYADSVKGRFTISRENSKNTLYLQMNSLTAEDTAVYYCARDLQYYGMDVWGQGTTVTVSS

SEQ ID NO: 4083 - protein, 11 aa, Artificial Sequence
  Synthetic
ARDLQYYGMDV

SEQ ID NO: 4084 - protein, 104 aa, Artificial Sequence
  Synthetic
DIQLTQSPLFTWVGDRVTITCRSSQGISSYLAWYQQKPGKAHKLLMYVASTLQSGVPSRFSGSGSGTDFTLTISSLQREDFATYYCQELNTYLTFGGGTKVEIK

SEQ ID NO: 4085 - protein, 8 aa, Artificial Sequence
  Synthetic
QELNTYLT

SEQ ID NO: 4086 - protein, 120 aa, Artificial Sequence
  Synthetic
EVQLVESGGGLIQPGGSLRLSCAASGFTVSLNYMTWVRQAPGKGLEWVSLIYSGGSTSYADSVKGRFTVSRDNSKNTLYLQMNSLRAEDTAVYHCARVAYHMGVTHFDSWGQGTLVTVSS

SEQ ID NO: 4087 - protein, 14 aa, Artificial Sequence
  Synthetic
ARVAYHMGVTHFDS

SEQ ID NO: 4088 - protein, 108 aa, Artificial Sequence
  Synthetic
DIQMTQSPSSLSASVGDRVTISCRASQNINNYLNWYQQKPGKAPKLLIYAASSLQSGVPSKFRGSGSGTDFTLTISSLQPEDFATYFCQQTYSTPQGTFGQGTKVEIK

SEQ ID NO: 4089 - protein, 10 aa, Artificial Sequence
  Synthetic
QQTYSTPQGT

SEQ ID NO: 4090 - protein, 117 aa, Artificial Sequence
  Synthetic
QLQLQESGPGLVRPSETLSLTCTVSGGSISSSSYYWGWIRQPPGKGLEWIGSIYDSGTTYYNPSLKSRVTIFVDTSKNQFSLRLKSVTAADTAIYYCARLLGLIDYWGQGALVTVSS

SEQ ID NO: 4091 - protein, 9 aa, Artificial Sequence
  Synthetic
ARLLGLIDY

SEQ ID NO: 4092 - protein, 108 aa, Artificial Sequence
  Synthetic
DIQMTQSPSSLSASVGDRVTITCRATQGISNSLAWYQQEPGKAPKLLLYAASTLESGVPSRFSGSGSGTDFTLTISTLQPEDFATYYCQQYYSAPPHTFGQGTKVDIK

SEQ ID NO: 4093 - protein, 10 aa, Artificial Sequence
  Synthetic
QQYYSAPPHT

SEQ ID NO: 4094 - protein, 120 aa, Artificial Sequence
  Synthetic
QVQLVESGGGVVQPGRSLRLSCAASGFTFSGYGMHWVRQAPGKGLEWVAVTSYDGSYKSYADSVKGRFTISRDNSKNTLYLQMNSLIVEDTAVYYCARDGGEVVTVFDYWGQGTLVTVSS

SEQ ID NO: 4095 - protein, 13 aa, Artificial Sequence
  Synthetic
ARDGGEVVTVFDY

SEQ ID NO: 4096 - protein, 108 aa, Artificial Sequence
  Synthetic
DIQMTQSPSSLSASVGDRVTITCRASQSIGTYLNWYQQKPGKAPKLLIYAASTLQSGVPSRFSGRGSGTDFTLTISGLQPEDFATYYCQQSYSSPPWTFGQGTKVEIK

SEQ ID NO: 4097 - protein, 10 aa, Artificial Sequence
  Synthetic
QQSYSSPPWT

SEQ ID NO: 4098 - protein, 124 aa, Artificial Sequence
  Synthetic
QVQLVESGGGVVQPGRSLRLSCAASGFTFRSHAMHWVRQAPGKGLEWVAVIWYDGSNQYYADSVKGRFTISRDSSKNTLFLQMNSLRAEDTAVYYCTREGIAAVGSKADAFDIWGQGTMVIVSS

SEQ ID NO: 4099 - protein, 17 aa, Artificial Sequence
  Synthetic
TREGIAAVGSKADAFDI

SEQ ID NO: 4100 - protein, 107 aa, Artificial Sequence
  Synthetic
DIQMTQSPSSLTASVGDRVIITCRASQSISSFLNWYQQRPGKAPKLLIYAASSLQSGVPSRFSGSGSGTDFTLTISSLQPEDFATYYCQQSSSTLYTFGQGTKLEIK

SEQ ID NO: 4101 - protein, 9 aa, Artificial Sequence
  Synthetic
QQSSSTLYT

SEQ ID NO: 4102 - protein, 117 aa, Artificial Sequence
  Synthetic
EVQLVETGGGLIQPGGSLRLSCAASGFTVSTNYMYWVRQAPGKGLEWVSLIYSGGSTYYADSVKGRFTISRHNSNNTLFLQMNSLRVEDTAIYYCARGPYPSSATRWGQGTLVTVSS

SEQ ID NO: 4103 - protein, 11 aa, Artificial Sequence
  Synthetic
ARGPYPSSATR

SEQ ID NO: 4104 - protein, 107 aa, Artificial Sequence
  Synthetic
DIQMTQSPSSLSASVGDRVTITCQASQDIISFLNWYQQKPGKAPKLLIYDASNLETGVPERFSGSGSGTHFTFTISSLQPEDVATYYCQQYDNLPIAFGGGTKVEIK

SEQ ID NO: 4105 - protein, 9 aa, Artificial Sequence
  Synthetic
QQYDNLPIA

SEQ ID NO: 4106 - protein, 124 aa, Artificial Sequence
  Synthetic
QVQLVESGGGVVQPGRSLRLSCAASGFTFRSHAMHWVRKAPGKGLECVAVIWYDGSNKYYADSVKGRFTISRDNSKNTLYLQMNSLRAEDTAVYYCAREGIAAAGSKADAFDIWGQGTMVTVSS

SEQ ID NO: 4107 - protein, 17 aa, Artificial Sequence
  Synthetic
AREGIAAAGSKADAFDI

SEQ ID NO: 4108 - protein, 107 aa, Artificial Sequence; identical to SEQ ID NO: 1644
  Synthetic

SEQ ID NO: 4109 - protein, 9 aa, Artificial Sequence
  Synthetic
QQSYSTLYT

SEQ ID NO: 4110 - protein, 117 aa, Artificial Sequence
  Synthetic
QLQLQESGPGLVKPSETLSLICTVSGDSISSSRYYWGWIRQPPGKGLEWIGSIFYTGSTYYNPSLKSRVTISADTSKNQFSLKLSSVTATDTAVYYCARLLGLIDYWGQGALVTVSS

SEQ ID NO: 4111 - protein, 9 aa, Artificial Sequence
  Synthetic
ARLLGLIDY

SEQ ID NO: 4112 - protein, 108 aa, Artificial Sequence
  Synthetic
DIQMTQSPSSLSASVGDRVAITCRASQAISNSLAWYQQIRGKAPKLLLYAASTLESGVPSRFSGSGSGTDYILTISSLQPEDFATYYCQQYYSPPPYTFGQGTTLEIK

SEQ ID NO: 4113 - protein, 10 aa, Artificial Sequence
  Synthetic
QQYYSPPPYT

SEQ ID NO: 4114 - protein, 117 aa, Artificial Sequence
  Synthetic
QLQLQESGPRQVKPSETLSLTCTVSGGSISSSGYYWGWIRQPPGKGLEWIGSIFYSGSTYYNPSLKSRVTISVDTSKNQFTLKVTSVTAADTAVYYCARLLGLIDYWGQGTLVTVSS

SEQ ID NO: 4115 - protein, 9 aa, Artificial Sequence
  Synthetic
ARLLGLIDY

SEQ ID NO: 4116 - protein, 108 aa, Artificial Sequence
  Synthetic
DIQMTQSPSSLSASVGDRVTITCRASQGITNSLAWYQQKPGKAPNLLLYAASTLESGVPSRFSGSGSGTDFTLTISSLQPEDFATYYCQQYYSSPPHTFGQGTKLEVK

SEQ ID NO: 4117 - protein, 10 aa, Artificial Sequence
  Synthetic
QQYYSSPPHT

SEQ ID NO: 4118 - protein, 121 aa, Artificial Sequence
  Synthetic
QVQLVESGGGVVQPGRSLRLSCGASGFTFRNYGMHWVRQAPGKGLEWVAVISDDGSYKDYADSVKGRFTISRDNSKNTLYLQMNSLRAEDTAVYYCARDWGPTTVTLFDYWGQGNLVTVSS

SEQ ID NO: 4119 - protein, 14 aa, Artificial Sequence
  Synthetic
ARDWGPTTVTLFDY

SEQ ID NO: 4120 - protein, 108 aa, Artificial Sequence
  Synthetic
DIQMTQSPSSLSASVGDRVTITCRASQSISNYLNWYQQKPGKTPKLLIYESSSLQSGVPSRFSGSGSGTDFTLTINSLQPEDFATYYCQQSYNTPPWTFGQGTKVEIK

SEQ ID NO: 4121 - protein, 10 aa, Artificial Sequence
  Synthetic
QQSYNTPPWT

SEQ ID NO: 4122 - protein, 125 aa, Artificial Sequence
  Synthetic
QVQLVQSGAEVKKPGASVKVSCKASGYSFSSDGISWVRQAPGQGLEWMGWISAYNGDTKYAQKFQGRLTMTTDTSTSTAYMELRSLRSDDTAVYYCARDLGWFGELSVGRDFDYWGQGTLVTVSS

SEQ ID NO: 4123 - protein, 18 aa, Artificial Sequence
  Synthetic
ARDLGWFGELSVGRDFDY

SEQ ID NO: 4124 - protein, 106 aa, Artificial Sequence
  Synthetic
EIVLTQSPATLSLSPGERATLSCRASQSVSSYLAWYQQKPGQPPRLLIYDASKRATGIPARFSGSGSGTDFTLTISSLEPEDFAVYYCHQRSNSYTFGQGTKLEIK

SEQ ID NO: 4125 - protein, 8 aa, Artificial Sequence
  Synthetic
HQRSNSYT

SEQ ID NO: 4126 - protein, 121 aa, Artificial Sequence
  Synthetic
QVQLQESGPGLVKPSQTLSLTCTVSGGSISSGGFYWSWIRQHPGKGLEWIGYIYYSGNTYYNPSLKSRVIISVDTSKNQFSLKLSSVTAADTAVYYCARDYGGNSNYFGYWGQGTLVTVSS

SEQ ID NO: 4127 - protein, 13 aa, Artificial Sequence
  Synthetic
ARDYGGNSNYFGY

SEQ ID NO: 4128 - protein, 107 aa, Artificial Sequence
  Synthetic
DIQMTQSPSSLSASVGDRVTITCQATQDISRYLSWYQQKPGKAPKLLIYDVSDLETGVPSRFSGSGSGTDFTFTISSLQPEDIATYYCQQYNNLPLTFGGGTKVEIK

SEQ ID NO: 4129 - protein, 9 aa, Artificial Sequence
  Synthetic
QQYNNLPLT

SEQ ID NO: 4130 - protein, 127 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKKGGPYCSGGSCNVGYFDYWGQGTLVTVSS

SEQ ID NO: 4131 - protein, 20 aa, Artificial Sequence
  Synthetic
AKKGGPYCSGGSCNVGYFDY

SEQ ID NO: 4132 - protein, 107 aa, Artificial Sequence; identical to SEQ ID NO: 2944
  Synthetic

SEQ ID NO: 4133 - protein, 9 aa, Artificial Sequence
  Synthetic
QQYDNLPLT

SEQ ID NO: 4134 - protein, 121 aa, Artificial Sequence
  Synthetic
QVQLVQSGAEVKKPGSSVKVSCKASGGTFSIYSISWVRQAPGQGLEWMGRIIPITGIANYAQKFQGRVTITADKSTSTAYMELSSLRSEDTAVYYCARYGYGDYVGWLDYWGQGTLVTVSS

SEQ ID NO: 4135 - protein, 14 aa, Artificial Sequence
  Synthetic
ARYGYGDYVGWLDY

SEQ ID NO: 4136 - protein, 107 aa, Artificial Sequence
  Synthetic
DIQMTQSPSSLSASVGDRVTITCQASQDISNYLNWYQQKSGKAPKLLIYDASNLETGVPSRFSGSGSGTDFTFTISSLQPEDIATYYCQHYDNLLGAFGPGTKVNIK

SEQ ID NO: 4137 - protein, 9 aa, Artificial Sequence
  Synthetic
QHYDNLLGA

SEQ ID NO: 4138 - protein, 127 aa, Artificial Sequence
  Synthetic
QVQLVQSGAEVKKPGSSVKVSCKASGGTFSSYTISWVRQAPGQGLEWMGRIIPILGIANYAQKFQGRVTITADKSTSTAYMELSSLRSEDTAVYYCASLPGGYDILTGPMNYYFDYWGQGTLVTVSS

SEQ ID NO: 4139 - protein, 20 aa, Artificial Sequence
  Synthetic
ASLPGGYDILTGPMNYYFDY

SEQ ID NO: 4140 - protein, 107 aa, Artificial Sequence
  Synthetic
DIQMTQSPSSLSASVGDRVTITCRASQSISSYLNWYQQKPGKAPKLLIYDASSLQSGVPSRFSGSGSGTDFTLTISSLQPEDFAIYYCQQSYSTPYTFGQGTKLEIK

SEQ ID NO: 4141 - protein, 9 aa, Artificial Sequence
  Synthetic
QQSYSTPYT

SEQ ID NO: 4142 - protein, 129 aa, Artificial Sequence
  Synthetic
QVQLQESGPGLVKPSQTLSLTCTVSGGSISSSGSYWSWIRQHPKKGLEWIGYIYYSGSTYFNPSLKSRVTISLDTSKSQFSLKLSSVTAADTAVYYCAREAIVVVGVSHRPYYYGMDVWGQGTTVTVSS

SEQ ID NO: 4143 - protein, 21 aa, Artificial Sequence
  Synthetic
AREAIVVVGVSHRPYYYGMDV

SEQ ID NO: 4144 - protein, 108 aa, Artificial Sequence
  Synthetic
EIVMTQSPATLSVSPGERATLSCRASQSISNNLAWYQQKPGQAPRLLIYGASTRATGIPARFSGSGSGTEFTLTISSLQSEDFAVYYCQQYNNWPPWTFGLGTKVEIK

SEQ ID NO: 4145 - protein, 10 aa, Artificial Sequence [sequence omitted]

SEQ ID NO: 4146 - protein, 122 aa, Artificial Sequence
  Synthetic
EVQLVQSGAEVKKPGESLKISCKGSGYTFTNYWIAWVRQMPGKGLEWMGSIYPGDSDTRYSPSFQGQVTISADKSISTAYLQWSSLKASDTAMYYCASFRSGSYYQDWFDPWGQGTLVTVSS

SEQ ID NO: 4147 - protein, 15 aa, Artificial Sequence
  Synthetic
ASFRSGSYYQDWFDP

SEQ ID NO: 4148 - protein, 108 aa, Artificial Sequence
  Synthetic
DIQMTQSPSSLSASVGDRVTITCRASQSISSYLNWYQQKPGKAPNLLIYGASSLQSGVPSRFSGSGSGTDFTLTISSLQPEDFATYYCQQSYSTPLVTFGPGTKVDIK

SEQ ID NO: 4149 - protein, 10 aa, Artificial Sequence
  Synthetic
QQSYSTPLVT

SEQ ID NO: 4150 - protein, 124 aa, Artificial Sequence
  Synthetic
QVQLVESGGGVVQPGRSLRLSCAASGFTFRTYAMHWVRQAPGKGLESVAVIWNDGSKKFYADSVKGRITISRDNSKSTLYLQMNSLRAEDTAVYYCAREGIAAAGSKADAFDIWGQGTMVTVSS

SEQ ID NO: 4151 - protein, 17 aa, Artificial Sequence
  Synthetic
AREGIAAAGSKADAFDI

SEQ ID NO: 4152 - protein, 107 aa, Artificial Sequence
  Synthetic
DIQMTQSPSSLSASVGDRVTITCRASQTISTYLNWYQQKPGKAPNLLIYAASSLQSGVPSRFSGSGSGTDFTLIISSLQPEDFATYYCQQSYSTLYTFGQGTKLDIK

SEQ ID NO: 4153 - protein, 9 aa, Artificial Sequence
  Synthetic
QQSYSTLYT

SEQ ID NO: 4154 - protein, 129 aa, Artificial Sequence
  Synthetic
QVQLVESGGGVVQPGRSLRLSCAASGFTFRMHAMHWVRQAPGKGLEWVTLIWNDGSNKNYAGSVKGRFTISRDNSKNTLYLQMNSLRAEDTALYFCAREGINGYASGWNGGAPDALDIWGQGTMVTVSS

SEQ ID NO: 4155 - protein, 22 aa, Artificial Sequence
  Synthetic
AREGINGYASGWNGGAPDALDI

SEQ ID NO: 4156 - protein, 108 aa, Artificial Sequence
  Synthetic
DIQMTQSPSSLSASIGDGVTITCRASQSISTYLNWYQQKPGKAPKLLIYAASSLQSGVPSRFSGSGSGTDFTLTISSLQPEDFATYYCQQSSNTLMYTFGQGTKLEIK

SEQ ID NO: 4157 - protein, 10 aa, Artificial Sequence
  Synthetic
QQSSNTLMYT

SEQ ID NO: 4158 - protein, 120 aa, Artificial Sequence
  Synthetic
EVQLVESGGGLVQPGRSLRLSCAASGFTFEDYAMHWVRQAPGKGLEWVSGISWNSGDIGYADSVKGRFTISRDNAKNSVYLQMNSLRAEDTALYYCAPSTVTTDDAFDIWGQGTMVTVSS

SEQ ID NO: 4159 - protein, 13 aa, Artificial Sequence
  Synthetic
APSTVTTDDAFDI

SEQ ID NO: 4160 - protein, 110 aa, Artificial Sequence
  Synthetic
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGTYVWVFGGGTKLTVL

SEQ ID NO: 4161 - protein, 10 aa, Artificial Sequence
  Synthetic
CSYAGTYVWV

SEQ ID NO: 4162 - protein, 125 aa, Artificial Sequence
  Synthetic
EVQLVESGGGLVQPGRSLRLSCAASGFTFDAYAMHWVRQAPGKGLEWVSGVTWNSGSIGYADSVKGRFTISRDNAKNSLYLQMNSLRAEDTALYYCAKDIGIHYDFRSRDAFDIWGQGTMVTVSS

SEQ ID NO: 4163 - protein, 18 aa, Artificial Sequence
  Synthetic
AKDIGIHYDFRSRDAFDI

SEQ ID NO: 4164 - protein, 110 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAWVFGGGTKLTVL

SEQ ID NO: 4165 - protein, 11 aa, Artificial Sequence
  Synthetic
GTWDSSLSAWV

SEQ ID NO: 4166 - protein, 130 aa, Artificial Sequence
  Synthetic
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARVLPNYLLEYYYDSSGPDAFDIWGQGTMVTVSS

SEQ ID NO: 4167 - protein, 23 aa, Artificial Sequence
  Synthetic
ARVLPNYLLEYYYDSSGPDAFDI

SEQ ID NO: 4168 - protein, 110 aa, Artificial Sequence
  Synthetic
QSVLTQPPSVSGSPGQSVTISCTGTSSDVGSYNRVSWYQQPPGTAPKLMIYEVSNRPSGVPDRFSGSKSGNTASLTISGLQAEDEADYYCSLYTSSSTYVFGTGTKVTVL

SEQ ID NO: 4169 - protein, 10 aa, Artificial Sequence
  Synthetic
SLYTSSSTYV

SEQ ID NO: 4170 - protein, 124 aa, Artificial Sequence
  Synthetic
QVQLVQSGAEVKKPGSSVKVSCKASGGTFSSYAISWVRQAPGHGLEWMGKIIPILGIANYPQKFQGRFTITADKSTGSAYMELSSLRSEDTAVYFCARERGYSDYGAAEYFDYWGQGTLVTVSS

SEQ ID NO: 4171 - protein, 17 aa, Artificial Sequence
  Synthetic
ARERGYSDYGAAEYFDY

SEQ ID NO: 4172 - protein, 111 aa, Artificial Sequence
  Synthetic
QSVLTQPPSVSGAPGQRVTVSCTGSSSNIGAGYDVHWYQQLPGTAPKLLIYGNTNRPSGVPDRFSGSKSGTSASLAITGLQAEDEADYYCQSYDSSLSGSVFGGGTKLTVL

SEQ ID NO: 4173 - protein, 11 aa, Artificial Sequence
  Synthetic
QSYDSSLSGSV

SEQ ID NO: 4174 - protein, 121 aa, Artificial Sequence
  Synthetic
QVQLVESGGGLVKPGGSLRLSCAASGFTFSDYYMSWIRQAPGKGLECISYISSNGSTIYFADSVKGRFTISRDNAKNSLYLQMNSLRAEDTAVYYCARGSLQYFDWLCYPWGQGTLVTVSS

SEQ ID NO: 4175 - protein, 14 aa, Artificial Sequence
  Synthetic
ARGSLQYFDWLCYP

SEQ ID NO: 4176 - protein, 109 aa, Artificial Sequence
  Synthetic
QSVLTQPPSASGTPGQRVTISCSGSSSNIGTNYVYWYQQLPGMAPKLLIYRNNLRPSGVPDRFSGSKSGTSASLAISGLRSEDEADYYCAAWDDSLSGLFGGGTKLTVL

SEQ ID NO: 4177 - protein, 10 aa, Artificial Sequence
  Synthetic
AAWDDSLSGL

SEQ ID NO: 4178 - protein, 122 aa, Artificial Sequence
  Synthetic
EVQLLESGGGLVQPGGSLRLSCAASGFTFSTYAMSWVRQAPGKGLEWVSAISGSGGSTNYADSVKGRFTISRDNSKNTLYLQMNSLRAEDTAVYYCAKDDYGDYVLGAFDIWGQGTMVTVSS

SEQ ID NO: 4179 - protein, 15 aa, Artificial Sequence
  Synthetic
AKDDYGDYVLGAFDI

SEQ ID NO: 4180 - protein, 110 aa, Artificial Sequence; identical to SEQ ID NO: 688
  Synthetic

SEQ ID NO: 4181 - protein, 10 aa, Artificial Sequence
  Synthetic
SSYAGSNNLV

SEQ ID NO: 4182 - protein, 120 aa, Artificial Sequence
  Synthetic
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREIVEGDGAFDIWGQGTMVTVSS

SEQ ID NO: 4183 - protein, 13 aa, Artificial Sequence
  Synthetic
AREIVEGDGAFDI

SEQ ID NO: 4184 - protein, 109 aa, Artificial Sequence
  Synthetic
QSVLTQPRSVSGSPGQSVTISCTGTSSDVGGYNYVSWYQQHPGKAPKLMIYNVSKRPSGVPDRFSGSKSGNTASLTISGLQAEDEADYYCCSYAGSLWVFGGGTKLTVL

SEQ ID NO: 4185 - protein, 9 aa, Artificial Sequence
  Synthetic
CSYAGSLWV

SEQ ID NO: 4186 - protein, 125 aa, Artificial Sequence
  Synthetic
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDLEHIVVVIASDAFDIWGQGTMVTVSS

SEQ ID NO: 4187 - protein, 18 aa, Artificial Sequence
  Synthetic
ARDLEHIVVVIASDAFDI

SEQ ID NO: 4188 - protein, 110 aa, Artificial Sequence
  Synthetic
QSVLTQPASVSGSPGQSITISCTGTSSDVGGYNYVSWYQQHPGKAPKLMIYEVSNRPSGVYNRFSGSKSGNTASLTISGLQAEDEADYYCSSYTSSSTLVFGTGTKVTVL

SEQ ID NO: 4189 - protein, 10 aa, Artificial Sequence
  Synthetic
SSYTSSSTLV

SEQ ID NO: 4190 - protein, 122 aa, Artificial Sequence
  Synthetic
QLQLQESGPGLVKPSETLSLTCTVSGGSISNYNYYWGWIRQPPGKGLEWIGSIYYSGSTYYNPSLKSRVTISVDTSKNQFSLKLSSVTAADTAVYYCARLTSAWPGIEVDYWGQGTLVTVSS

SEQ ID NO: 4191 - protein, 14 aa, Artificial Sequence
  Synthetic
ARLTSAWPGIEVDY

SEQ ID NO: 4192 - protein, 110 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGTGTKVTVL

SEQ ID NO: 4193 - protein, 11 aa, Artificial Sequence
  Synthetic
GTWDSSLSAGV

SEQ ID NO: 4194 - protein, 125 aa, Artificial Sequence
  Synthetic
QVQLVQSGSELKKPGASVKVSCKASGYTFTSYAMNWVRQAPGQGLEWMGWINTNTGNPTYAQGFTGRFVFSLDTSVSTAYLQIRSLKAEDTAVYYCARNYDFWSGYYYYYYMDVWGKGTTVTVSS

SEQ ID NO: 4195 - protein, 18 aa, Artificial Sequence
  Synthetic
ARNYDFWSGYYYYYYMDV

SEQ ID NO: 4196 - protein, 110 aa, Artificial Sequence
  Synthetic
QSVLTQPPSASGTPGQRVTISCSGSSSNIESTTVNWYQQLPGTAPKLLIYSNNQRPSGVPDRFSGSKSGTSASLAISGLQSEDEADYYCAAWDDSLNGVVFGGGTKLTVL

SEQ ID NO: 4197 - protein, 11 aa, Artificial Sequence
  Synthetic
AAWDDSLNGVV

SEQ ID NO: 4198 - protein, 128 aa, Artificial Sequence
  Synthetic
QVQLQQWGAGLLKPSETLSLICAVYGGSFSGYYWSWIRQPPGKGLEWIGEINHSGSTNYNPSLKSRVTISVDTSKNQFSLKLTSVTAADTAVYYCARLVSWSPFWSGYDYFYYYMDVWGKGTTVTVSS

SEQ ID NO: 4199 - protein, 22 aa, Artificial Sequence
  Synthetic
ARLVSWSPFWSGYDYFYYYMDV

SEQ ID NO: 4200 - protein, 111 aa, Artificial Sequence
  Synthetic
QSVLTQPPSVSGAPGQRVTISCTGSSSNIGADYDVHWYQQLPGTAPKLLIFGNNNRPSGVPDRFSGSKSGTSASLAITGLQAEDEADYYCQSYDSSLSGSRVFGGGTKLTV

SEQ ID NO: 4201 - protein, 12 aa, Artificial Sequence
  Synthetic
QSYDSSLSGSRV

SEQ ID NO: 4202 - protein, 122 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARWYSAYDPGYNWFDPWGQGTLVTVSS

SEQ ID NO: 4203 - protein, 16 aa, Artificial Sequence
  Synthetic
ARWYSAYDPGYNWFDP

SEQ ID NO: 4204 - protein, 109 aa, Artificial Sequence
  Synthetic
SYVLTQPPSVSVAPGQTARITCGGNTIGSKSVHWYQQKPGQAPVLVVYDDSDRPSGIPERFSGSNSGNTATLTISRVEDGDEADYYCQVWDGSSDHYVVFGGGTKLTVL

SEQ ID NO: 4205 - protein, 12 aa, Artificial Sequence
  Synthetic
QVWDGSSDHYVV

SEQ ID NO: 4206 - protein, 125 aa, Artificial Sequence; identical to SEQ ID NO: 4186
  Synthetic

SEQ ID NO: 4207 - protein, 18 aa, Artificial Sequence
  Synthetic
ARDLEHIVVVIASDAFDI

SEQ ID NO: 4208 - protein, 110 aa, Artificial Sequence
  Synthetic
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVL

SEQ ID NO: 4209 - protein, 10 aa, Artificial Sequence
  Synthetic
SSYTSSSTLV

SEQ ID NO: 4210 - protein, 124 aa, Artificial Sequence
  Synthetic
QVQLVQSGAEVKKPGASVKVSCKASGYTFTSYGITWVRQAPGQGLEWMGWISAYNGNTNYAQKLQGRVTMTTDTSTSTAYMELRSLRSDDTAVYYCARDVGGNPRYYYYGMDVWGQGTTVTVSS

SEQ ID NO: 4211 - protein, 17 aa, Artificial Sequence
  Synthetic
ARDVGGNPRYYYYGMDV

SEQ ID NO: 4212 - protein, 110 aa, Artificial Sequence
  Synthetic
QSVLTQPPSVSGTPGQRVSISCSGSSSNIGSNTVNWYQHLPGTAPKLLIYSNNQRPSGVPDRFSGAKSGTSASLAISGLQSEDEADYFCAAWDDSLNGWVFGGGTKLTVL

SEQ ID NO: 4213 - protein, 11 aa, Artificial Sequence
  Synthetic
AAWDDSLNGWV

SEQ ID NO: 4214 - protein, 128 aa, Artificial Sequence
  Synthetic
EVQLVESGGGLVQPGGSLRLSCAASGFSFSSYWMSWVRQAPGKGLEWVANIKEDGSEKYYVDSVKGRFTISRDNAKNSLYLQMNSLRAEDTALYYCARDRSCRGGSCLRPYYYYMDVWGKGTTVTVSS

SEQ ID NO: 4215 - protein, 21 aa, Artificial Sequence
  Synthetic
ARDRSCRGGSCLRPYYYYMDV

SEQ ID NO: 4216 - protein, 110 aa, Artificial Sequence
  Synthetic
QSVLTQPPSASGTPGQRVTISCSGSSSNIGSNTVNWYQHLPGTAPKLLIYSDNWRPSGVPDRFSGSKSGTSASLAISGLQSEDEADYYCAAWDNSLNGYVFGTGTKVTVL

SEQ ID NO: 4217 - protein, 11 aa, Artificial Sequence
  Synthetic
AAWDNSLNGYV

SEQ ID NO: 4218 - protein, 128 aa, Artificial Sequence
  Synthetic
EVQLVESGGGLVKPGGSLRLSCAASGFTFNIYSMNWVRQAPGKGLEWVSSISSSSSYIYYADSLKGRFTISRDNAKNSLYLQMNSLRAEDTAVYYCARVGGEDIVVLPAAILGEFDIWGQGTMVTVSS

SEQ ID NO: 4219 - protein, 21 aa, Artificial Sequence
  Synthetic
ARVGGEDIVVLPAAILGEFDI

SEQ ID NO: 4220 - protein, 110 aa, Artificial Sequence
  Synthetic
QSVLTQPPSASGTPGQRVTISCSGSSSNIGSNYVYWYQQLPGTAPKLLIYRNYLRPSGVPDRFSGSKSATSASLAISGLRSEDEADYYCAAWDDSLSGVVFGGGTKLTVL

SEQ ID NO: 4221 - protein, 11 aa, Artificial Sequence
  Synthetic
AAWDDSLSGVV

SEQ ID NO: 4222 - protein, 124 aa, Artificial Sequence
  Synthetic
QVQLVQSGAEVKKPGSSVKVSCKASGGTFSSYAISWVRQAPGQGLEWMGRIIPILGIANYAQKFQGRVTITADKSTTTAYMELNSLRSEDTAVYYCARERGYSGYGAAEYFDFWGQGTLVTVSS

SEQ ID NO: 4223 - protein, 17 aa, Artificial Sequence
  Synthetic
ARERGYSGYGAAEYFDF

SEQ ID NO: 4224 - protein, 111 aa, Artificial Sequence
  Synthetic
QSVLTQPPSVSGAPGQRVTISCAGSSSNVGAGYDVHWYQQLSGTAPKLLIYGNSNRPSGVPDRFSGSKSGTSASLAITGLQAEDEADYYCQSYDSSLSGSVFGGGTKLTVL

SEQ ID NO: 4225 - protein, 11 aa, Artificial Sequence
  Synthetic
QSYDSSLSGSV

SEQ ID NO: 4226 - protein, 123 aa, Artificial Sequence
  Synthetic
QVQLQESGPGLVKPSQTLSLTCTVSGGSISSGGYYWSWIRQHPGKGLEWIGYIYYSENTYYNPSLKSRVTISVDTSKNQFSLKLNSVTAADTAVYYCARGGLVVPAAARWDVWGKGTTVTVSS

SEQ ID NO: 4227 - protein, 15 aa, Artificial Sequence
  Synthetic
ARGGLVVPAAARWDV

SEQ ID NO: 4228 - protein, 110 aa, Artificial Sequence
  Synthetic
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVLGGGTKLTVL

SEQ ID NO: 4229 - protein, 11 aa, Artificial Sequence
  Synthetic
AAWDDSLSGPV

SEQ ID NO: 4230 - protein, 121 aa, Artificial Sequence
  Synthetic
QVQLVQSGAEVKKPGASVKVSCKASGYTFTSYYIYWVRQAPGQGLEWVGMINPTGGSTSYAQKFQGRVAMTRDTSTSTVYMELSNLRSEDTAVYYCARSRVVPAADWFDPWGQGTLVTVSS

SEQ ID NO: 4231 - protein, 14 aa, Artificial Sequence
  Synthetic
ARSRVVPAADWFDP

SEQ ID NO: 4232 - protein, 109 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDGSSDHHVVFGGGTKLTVL

SEQ ID NO: 4233 - protein, 12 aa, Artificial Sequence
  Synthetic
QVWDGSSDHHVV

SEQ ID NO: 4234 - protein, 119 aa, Artificial Sequence
  Synthetic
EVQLVESGGGLIQPGGSLRLSCAASGITVSSNYMSWVRQAPGKGLEWVSVIYSGGSTFYADSVKGRFTISRDNSKNTLYLQMNSLRAEDTAVYYCARGEGANPYGMDVWGQGTTVTVSS

SEQ ID NO: 4235 - protein, 13 aa, Artificial Sequence
  Synthetic
ARGEGANPYGMDV

SEQ ID NO: 4236 - protein, 112 aa, Artificial Sequence
  Synthetic
QSVLTQPPSVSGAPGQRVTISCTGSSSNIGAGYDVHWYQQLPGTAPKLLIYGNNNRPSGVPDRFSGSKSGTSASLAITGLQAEDEADYYCQSYDSSLSGHVVFGGGTKLTVL

SEQ ID NO: 4237 - protein, 12 aa, Artificial Sequence
  Synthetic
QSYDSSLSGHVV

SEQ ID NO: 4238 - protein, 125 aa, Artificial Sequence; identical to SEQ ID NO: 4186
  Synthetic

SEQ ID NO: 4239 - protein, 18 aa, Artificial Sequence
  Synthetic
ARDLEHIVVVIASDAFDI

SEQ ID NO: 4240 - protein, 110 aa, Artificial Sequence
  Synthetic
QSVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVL

SEQ ID NO: 4241 - protein, 10 aa, Artificial Sequence
  Synthetic
SSYTSSSTLV

SEQ ID NO: 4242 - protein, 123 aa, Artificial Sequence
  Synthetic
QVQLQESGPGLVKPSETLSLTCTVSGGSISSYFWSWIRQPPGKGLEWIGYVYYIGSTNYNPSLKSRVTISVDTSKNQFSLKLSSVTAADTAVYYCARVTGYSGPGANHYFDYWGQGTLVTVSS

SEQ ID NO: 4243 - protein, 17 aa, Artificial Sequence
  Synthetic
ARVTGYSGPGANHYFDY

SEQ ID NO: 4244 - protein, 111 aa, Artificial Sequence
  Synthetic
QSVLTQPPSVSGAPGQRVTISCTGSSSNIGSGYDVHWYQQLPETAPKLLIHGNSNRPSGVPDRFSGSKSGTSASLAITGLQAEDEADYYCQSYDSSLSGVVFGGGTKLTVL

SEQ ID NO: 4245 - protein, 11 aa, Artificial Sequence
  Synthetic
QSYDSSLSGVV

SEQ ID NO: 4246 - protein, 127 aa, Artificial Sequence
  Synthetic
QVQLVQSGAEVKKPGSSVKVSCKASGGTFSSYVINWVRQAPGQGLEWMGKIIPILGVAYDAQKFQGRVTITADRSTSTAYMELSSLRSEDTAVYYCAKMGPPEYGSGSGANEAFDIWGQGTMVTVSS

SEQ ID NO: 4247 - protein, 20 aa, Artificial Sequence
  Synthetic
AKMGPPEYGSGSGANEAFDI

SEQ ID NO: 4248 - protein, 111 aa, Artificial Sequence
  Synthetic
QSVLTQPPSVSGAPGQRVTISCTGSSSNIGAGYDVHWYQQLPGTAPKLLIFGNSNRPSGVPDRFSGSKSDTSASLAITGLQAEDEADYYCQSYDSSLSGSSFGTGTKVTVL

SEQ ID NO: 4249 - protein, 11 aa, Artificial Sequence
  Synthetic
QSYDSSLSGSS

SEQ ID NO: 4250 - protein, 124 aa, Artificial Sequence
  Synthetic
QVQLVQSGAEVKKPGSSVKVSCKASGGTFSSYAISWVRQAPGQGLEWMGRIIPILGIANYAQKFQGRVTITADKSTSRAYMELSSLRSEDTAVYYCARERGYSGYGAAEYFDYWGQGTLVTVSS

SEQ ID NO: 4251 - protein, 17 aa, Artificial Sequence
  Synthetic
ARERGYSGYGAAEYFDY

SEQ ID NO: 4252 - protein, 111 aa, Artificial Sequence
  Synthetic
QSVLTQPPSVSGAPGQRVTISCTGSSSNIGAGYDVHWYQQLPGTAPKLLIYVNSNRPSGVPDRFSGSKSGTSASLAITGLQAEDEADYYCQSYDSSLSGSVFGGGTKLTVL

SEQ ID NO: 4253 - protein, 11 aa, Artificial Sequence
  Synthetic
QSYDSSLSGSV

SEQ ID NO: 4254 - protein, 117 aa, Artificial Sequence
  Synthetic
EVQLVESGGGLIQPGGSLRLSCAASGLIVSSYMSWVRQAPGKGLEWVSVIYSGGSTFYADFVKGRFTISRDNSKNTLYLQMNSLRAEDTAVYYCARGEGWDLPFDYWGQGTLVTVSS

SEQ ID NO: 4255 - protein, 12 aa, Artificial Sequence
  Synthetic
ARGEGWDLPFDY

SEQ ID NO: 4256 - protein, 110 aa, Artificial Sequence
  Synthetic
QSALTQPPSASGSPGQSVTISCTGTSSDVGGYKYVSWYQQHPGKAPKLMIYEVSKRPSGVPDRFSGSKSGNTASLTVSGLQAEDEADYYCSSYAGSNNLVFGGGTKLTVL

SEQ ID NO: 4257 - protein, 10 aa, Artificial Sequence
  Synthetic
SSYAGSNNLV

SEQ ID NO: 4258 - protein, 121 aa, Artificial Sequence
  Synthetic
EVQLVESGGGLVQPGGSLRLSCAASGFTFSNWMHWVRQAPGKGLVWVSLINSDGSTTSYADSVKGRFTISRDNAKNTLYLQMNSLRAEDTAVYYCARDWGYGDYYYYMDVWGKGTTVTVSS

SEQ ID NO: 4259 - protein, 15 aa, Artificial Sequence
  Synthetic
ARDWGYGDYYYYMDV

SEQ ID NO: 4260 - protein, 110 aa, Artificial Sequence
  Synthetic
QSVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVL

SEQ ID NO: 4261 - protein, 10 aa, Artificial Sequence
  Synthetic
SSYTSSSTYV

SEQ ID NO: 4262 - protein, 125 aa, Artificial Sequence
  Synthetic
QVQLVQSGAEVRKPGASVKVSCKASGYTFTSYSMHWVRQAPGQGLEWMGIIYPSGGSTSSAQKFQDRVTMTRDTSTSTVYMELSSLRSEDTAVYYCAREGARAGRMGVADWFDPWGQGTLVTVSS

SEQ ID NO: 4263 - protein, 18 aa, Artificial Sequence
  Synthetic
AREGARAGRMGVADWFDP

SEQ ID NO: 4264 - protein, 110 aa, Artificial Sequence
  Synthetic
SYVLTQPPSVSVAPGQTARITCAENNIGSKSVHWYQQKPGQAPVLVVYDDSDRPSGIPERFSGSNSGNTATLTISRVEAGDEADYYCQVWDGTSDHPGYVFGTGTKVTVL

SEQ ID NO: 4265 - protein, 13 aa, Artificial Sequence
  Synthetic
QVWDGTSDHPGYV

SEQ ID NO: 4266 - protein, 127 aa, Artificial Sequence
  Synthetic
QLQLQESGPGLVKPSETLSLTCTVSGGSISSSTYYWGWIRQPPGKGLEWIGSIYYSESTYYNPSLKSRVTISVDTSKNQFSLKLSSVTAADTAVYYCARHAMGSGYYTNFGFYFQHWGQGTLVTVSS

SEQ ID NO: 4267 - protein, 19 aa, Artificial Sequence
  Synthetic
ARHAMGSGYYTNFGFYFQH

SEQ ID NO: 4268 - protein, 109 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWESSGDHLYVFGTGTKVTVL

SEQ ID NO: 4269 - protein, 12 aa, Artificial Sequence
  Synthetic
QVWESSGDHLYV

SEQ ID NO: 4270 - protein, 117 aa, Artificial Sequence
  Synthetic
EVQLVESGGGLIQPGGSLRLSCAASGLTVSSNYMSWVRQAPGKGLEWVSVIYPGGSTDYADSVKGRFTISRDNSKNTLYLQMNSLRAEDTAVYYCARDLVTYGMDVWGQGTTVTVSS

SEQ ID NO: 4271 - protein, 11 aa, Artificial Sequence
  Synthetic
ARDLVTYGMDV

SEQ ID NO: 4272 - protein, 105 aa, Artificial Sequence
  Synthetic
DIQLTQSPSFLSASVGDRVTITCRASISSYLAWYQQKPGKAPKLLIYVASTLQSGVPSRFSGSGSGTDFTLTISSLQPEDFATYYCQQLNSYPFTFGQGTRLEIK

SEQ ID NO: 4273 - protein, 9 aa, Artificial Sequence
  Synthetic
QQLNSYPFT

SEQ ID NO: 4274 - protein, 122 aa, Artificial Sequence
  Synthetic
QVQLVQSGAEVKKPGASVKVSCKASGYTFSSYYMHWVRQAPGQGLEWMGIINPSAGSTTYAQKFQGRVTMTSDTSTSTVYMELSSLRSEDTAVYYCARDIVLVPAMGAFDVWGQGTMVIVSS

SEQ ID NO: 4275 - protein, 15 aa, Artificial Sequence
  Synthetic
ARDIVLVPAMGAFDV

SEQ ID NO: 4276 - protein, 108 aa, Artificial Sequence
  Synthetic
EIVLTQSPATLSLSPGERATLSCRASQSVSSYLAWYQQKPGQAPRLLIYDASNRATGIPARFIGSGSGTDFTLTISSLEPEDFAVYYCQQRSHRPRYTFGQGTKLEIK

SEQ ID NO: 4277 - protein, 10 aa, Artificial Sequence
  Synthetic
QQRSHRPRYT

SEQ ID NO: 4278 - protein, 126 aa, Artificial Sequence
  Synthetic
EVQLVESGGGLVKPGGSLRLSCAASGFTFTSYSMNWVRQAPGKGPEWVSSISGSGTHIYYVDSVRGRFTISRDNANDSLYLQMNSLRAEDTAVYYCAITLSGYCSSSSCSYPWGPWGQGTLVTVSS

SEQ ID NO: 4279 - protein, 19 aa, Artificial Sequence
  Synthetic
AITLSGYCSSSSCSYPWGP

SEQ ID NO: 4280 - protein, 107 aa, Artificial Sequence
  Synthetic
DIQMTQSPSSLSASVGDRVTITCRASQNIHSYLNWYQQKPGKAPNLLIYGTSSLQSGVPSSFSGSGSGTEFTLTISSLQPEDFATYYCQQSYSTPFTFGPGTKVDIK

SEQ ID NO: 4281 - protein, 9 aa, Artificial Sequence
  Synthetic
QQSYSTPFT

SEQ ID NO: 4282 - protein, 124 aa, Artificial Sequence
  Synthetic
QVQLVESGGGVVQPGRSLRLSCAASGFTFRSYAMHWVRQAPGKGLEWVAVISYDGSSKYYADSVRGRFTISRDNSKNTLYVQMNSLRAEDTAVYYCARDDDSGWYGRGGFFDSWGQGTLVTVSS

SEQ ID NO: 4283 - protein, 17 aa, Artificial Sequence
  Synthetic
ARDDDSGWYGRGGFFDS

SEQ ID NO: 4284 - protein, 108 aa, Artificial Sequence; identical to SEQ ID NO: 3624
  Synthetic

SEQ ID NO: 4285 - protein, 10 aa, Artificial Sequence
  Synthetic
QQYDNLPPYT

SEQ ID NO: 4286 - protein, 114 aa, Artificial Sequence
  Synthetic
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDFKDEAWGQGTLVTVSS

SEQ ID NO: 4287 - protein, 8 aa, Artificial Sequence
  Synthetic
ARDFKDEA

SEQ ID NO: 4288 - protein, 107 aa, Artificial Sequence; identical to SEQ ID NO: 2880
  Synthetic

SEQ ID NO: 4289 - protein, 9 aa, Artificial Sequence
  Synthetic
QQYDNLPRT

SEQ ID NO: 4290 - protein, 127 aa, Artificial Sequence
  Synthetic
QVQLVESGGGVVQPGRSLRLSCAASGFTFSTYTMHWVRQAPGKGLEWVAVISYDGSNENYADSLKGRFTISRDNSKNTLYLQMNSLRAEDTAVYYCAKNLGVYYYDSSGYYLYFDYWGQGTLVTVSS

SEQ ID NO: 4291 - protein, 20 aa, Artificial Sequence
  Synthetic
AKNLGVYYYDSSGYYLYFDY

SEQ ID NO: 4292 - protein, 106 aa, Artificial Sequence
  Synthetic
DIQMTQSPSTLSASVGDRVTITCRASQSISSWLAWYQQKPGKAPKLLIYDASSLESGVPTRFSGSGSGTEFTLTISSLQPDDFATYYCQQYNSYPTFGGGTKVEIK

SEQ ID NO: 4293 - protein, 8 aa, Artificial Sequence
  Synthetic
QQYNSYPT

SEQ ID NO: 4294 - protein, 122 aa, Artificial Sequence
  Synthetic
QVQLVQSGAEVKKPGASVKVSCKASGYTFTTYYMHWVRQAPGQGLEWMGIINPSAGSTTYAQKFQGRVTMTTDTSTSTVYMELSSLRSEDTAVYYCARDLGLIPAANAFEIWGQGTMVTVSS

SEQ ID NO: 4295 - protein, 15 aa, Artificial Sequence
  Synthetic
ARDLGLIPAANAFEI

SEQ ID NO: 4296 - protein, 107 aa, Artificial Sequence
  Synthetic
EIVLTQSPATLSLSPGERATLSCRASQSVSSYLAWYQQKPGQAPRLLIYDASNRATGIPARFSGSGFGTDFTFTISSLEPEDFAVYYCQQRSNWPPFTFGPGTKVEI

SEQ ID NO: 4297 - protein, 10 aa, Artificial Sequence
  Synthetic
QQRSNWPPFT

SEQ ID NO: 4298 - protein, 124 aa, Artificial Sequence
  Synthetic
EVQLVQSGAEVKKPGESLKISCKGSGYSFSTYWIGWVRQMPGKGLEWMGIIYPGDSDTRYSPSFQGQVTISADKSISTAYLQWSSLKASDTAMYYCARHNYGDYGGGPNWIDPWGQGTLVTVSS

SEQ ID NO: 4299 - protein, 17 aa, Artificial Sequence
  Synthetic
ARHNYGDYGGGPNWIDP

SEQ ID NO: 4300 - protein, 107 aa, Artificial Sequence
  Synthetic
DIQMTQSPSSLSASVGDRVTITCRASQSISSYLNWYQQKPGKAPKLLIYVASSLQSGVPSRFSGSGSGTDFTLTISSLQPEDFATYYCQQSYSTPRTFGQGTKVEIK

SEQ ID NO: 4301 - protein, 9 aa, Artificial Sequence
  Synthetic
QQSYSTPRT

SEQ ID NO: 4302 - protein, 126 aa, Artificial Sequence; identical to SEQ ID NO: 4278
  Synthetic

SEQ ID NO: 4303 - protein, 19 aa, Artificial Sequence
  Synthetic
AITLSGYCSSSSCSYPWGP

SEQ ID NO: 4304 - protein, 107 aa, Artificial Sequence; identical to SEQ ID NO: 4280
  Synthetic

SEQ ID NO: 4305 - protein, 9 aa, Artificial Sequence
  Synthetic
QQSYSTPFT

SEQ ID NO: 4306 - protein, 119 aa, Artificial Sequence
  Synthetic
EVQLVESGGGLIQPGGSLRLSCAASGFTVSSNYMSWVRQAPGKGLEWVSIIYSGGSTFYADSVKGRFTISRDNSKNTLYLQMNSLRAEDTAVYYCARVLPLYGDYEDYWGQGTLVTVSS

SEQ ID NO: 4307 - protein, 13 aa, Artificial Sequence
  Synthetic
ARVLPLYGDYEDY

SEQ ID NO: 4308 - protein, 107 aa, Artificial Sequence
  Synthetic
DIQMTQSPSSLSASVGDRVTITCRASQSISNYLNWYQQKPGKAPKLLIYAASSLQSGVPSRFSGSGSGTDFTLTISSLQPEDFATYYCQQSYSTPRTFGQGTKVEIK

SEQ ID NO: 4309 - protein, 9 aa, Artificial Sequence
  Synthetic
QQSYSTPRT

SEQ ID NO: 4310 - protein, 117 aa, Artificial Sequence
  Synthetic
EVQLVESGGGLVQPGGSLRLSCAASGFTVSSNYMTWVRQAPGKGLEWVSVIYSGGSTFYADSVKGRFTISRDNSKNTLYLQMNSLRAEDTAVYYCARDYGEQWLDYWGQGTLVTVSS

SEQ ID NO: 4311 - protein, 11 aa, Artificial Sequence
  Synthetic
ARDYGEQWLDY

SEQ ID NO: 4312 - protein, 108 aa, Artificial Sequence
  Synthetic
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPRTFGQGTKLEIK

SEQ ID NO: 4313 - protein, 9 aa, Artificial Sequence
  Synthetic
QQYGSSPRT

SEQ ID NO: 4314 - protein, 126 aa, Artificial Sequence
  Synthetic
EVQLVQSGAEVKKPGESLKISCKGSGYSFTTYWIGWVRQMPGKGLEWMGIIYPGDSDTRYSPSFQGQVTISADKSVNTAYVQWSSLKASDTAMYYCASSTFGYCSGGNCFDTFDIWGQGTMVTVSS

SEQ ID NO: 4315 - protein, 19 aa, Artificial Sequence
  Synthetic
ASSTFGYCSGGNCFDTFDI

SEQ ID NO: 4316 - protein, 107 aa, Artificial Sequence
  Synthetic
EIVLTQSPATLSLSPGERATLSCRASQSVSSYLAWYQQIPGQAPRLLIYDASNRATGIPARFSGSGSGTDFTLTISSLEPEDFAVYYCQQRSNWPYTFGQGTKLEIK

SEQ ID NO: 4317 - protein, 9 aa, Artificial Sequence
  Synthetic
QQRSNWPYT

SEQ ID NO: 4318 - protein, 127 aa, Artificial Sequence
  Synthetic
QVQLQQWGAGLLKPSETLSRTCAVYGGSFSGYFWSWIRQPPGKGLEWIGEINYSGSTNYNPSLKSRVTISVDTSKNQFSLRLSSVTAADTAMYYCARGRPENIAGHYDSWSGSVEIWGQGTLVTVSS

SEQ ID NO: 4319 - protein, 21 aa, Artificial Sequence
  Synthetic
ARGRPENIAGHYDSWSGSVEI

SEQ ID NO: 4320 - protein, 107 aa, Artificial Sequence
  Synthetic
EIVLTQSPGTLSLSPGERATLSCRASQSVSSSYLAWYQQKPGQAPRLLIYDASIRATGIPDRFSGSGSGTDFTLTISRLEPEDFAVYYCQQYGGSFTFGPGTKVDIK

SEQ ID NO: 4321 - protein, 8 aa, Artificial Sequence
  Synthetic
QQYGGSFT

SEQ ID NO: 4322 - protein, 119 aa, Artificial Sequence
  Synthetic
QLQLQESGPGVVKPSETLSLTCTVSGGSISSSRYYWGWIRQPPGRGLEWIGTIYYGGSTYYNPSLKSRVTISVDTSKNQFSLKLNSVTAADTAVYYCARLYGASLAAEWGQGTLVTVSS

SEQ ID NO: 4323 - protein, 11 aa, Artificial Sequence
  Synthetic
ARLYGASLAAE

SEQ ID NO: 4324 - protein, 105 aa, Artificial Sequence
  Synthetic
DIQMTQSPSSLSASVGDVTITCRASQGISNSLAWYQHKPGKAPKLLLYAASTLESGVPSRFSGSGSGTDYTLTISSLQPEDFATFYCQQYYSIPSFGGGTKVEIK

SEQ ID NO: 4325 - protein, 8 aa, Artificial Sequence
  Synthetic
QQYYSIPS

SEQ ID NO: 4326 - protein, 121 aa, Artificial Sequence
  Synthetic
QVQLQQWGAGLLKPSETLSRTCAVYGGSFSGYYWSWIRQPPGKGLEWIGEINHSGSTNYNPSLKSRVTISVDTSKNQFSLKLSSVTAADTAIYYCARVSLRSGSPGGFDIWGQGRMVTVSS

SEQ ID NO: 4327 - protein, 15 aa, Artificial Sequence
  Synthetic
ARVSLRSGSPGGFDI

SEQ ID NO: 4328 - protein, 106 aa, Artificial Sequence
  Synthetic
DIQMTQSPSTLSASVGDRVTITCRASQSISSWLAWYQQKPGKAPKLLIYKASNLESGVPSRFSGSGSGTEFTLTISSLQADDSATYYCQQYNSYRTFGQGTKVEIK

SEQ ID NO: 4329 - protein, 8 aa, Artificial Sequence
  Synthetic
QQYNSYRT

SEQ ID NO: 4330 - protein, 132 aa, Artificial Sequence
  Synthetic
EVQLVESGGALVQPGGSLRLSCVASGFTFSSYWMSWVRQAPGKGLEWVADIKQDGSEKYYVDSVKGRFTISRDNAKNSLYLQMNSLRAEDTAVYYCARDGGPNYFDSSGYYYDYYYYGMDVWGQGTTVTVSS

SEQ ID NO: 4331 - protein, 25 aa, Artificial Sequence
  Synthetic
ARDGGPNYFDSSGYYYDYYYYGMDV

SEQ ID NO: 4332 - protein, 107 aa, Artificial Sequence
  Synthetic
DIQMTQSPSSLSASVGDRVTITCRASQSISSYLNWYQQKPGKAPKLLIYAASSLQSGVPSRLSGSGSGTDFTLTISSLQPEDLATYYCQQSYSTPWTFGQGTKVEIK

SEQ ID NO: 4333 - protein, 9 aa, Artificial Sequence
  Synthetic
QQSYSTPWT

SEQ ID NO: 4334 - protein, 126 aa, Artificial Sequence; identical to SEQ ID NO: 4278
  Synthetic

SEQ ID NO: 4335 - protein, 19 aa, Artificial Sequence
  Synthetic
AITLSGYCSSSSCSYPWGP

SEQ ID NO: 4336 - protein, 107 aa, Artificial Sequence; identical to SEQ ID NO: 4280
  Synthetic

SEQ ID NO: 4337 - protein, 9 aa, Artificial Sequence
  Synthetic
QQSYSTPFT

SEQ ID NO: 4338 - protein, 123 aa, Artificial Sequence
  Synthetic
QVQLVESGGGLVKPGGSLRLSCAASGFTFNDYYMTWIRQASGKGLEWVSYISTSGSTISYADSVKGRFTISRDNAKNSLYLQMNSLRAEDTAVYYCAREWGGDPNTPDAFDIWGQGTMVTVSS

SEQ ID NO: 4339 - protein, 16 aa, Artificial Sequence
  Synthetic
AREWGGDPNTPDAFDI

SEQ ID NO: 4340 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFASYYCQQSHSTPPTFGQGTKLEIK

SEQ ID NO: 4341 - protein, 9 aa, Artificial Sequence
  Synthetic
QQSHSTPPT

SEQ ID NO: 4342 - protein, 122 aa, Artificial Sequence
  Synthetic
QVQLVQSGAEVKKPGASVKVSCKASGYTFTSYYMHWVRQAPGQGLEWMGIINPSGGSTSYAQKFQGRVTMTTDTSTSTVYMELSSLRSDDTAVYYCSRDWAFIPAAGPFDYWGQGTLVTVSS

SEQ ID NO: 4343 - protein, 15 aa, Artificial Sequence
  Synthetic
SRDWAFIPAAGPFDY

SEQ ID NO: 4344 - protein, 107 aa, Artificial Sequence
  Synthetic
EIVLTQSPGTLSLSPGERATLSCRASQTVSSSYLAWYQQKPGQAPRLLIYGASSRATGIPDRFSGSGSGTDFTLTISRLEPEDFAVYYCQQYGSSWTFGQGTKVEIK

SEQ ID NO: 4345 - protein, 8 aa, Artificial Sequence
  Synthetic
QQYGSSWT

SEQ ID NO: 4346 - protein, 122 aa, Artificial Sequence
  Synthetic
EVQLVESGGGLVQPGRSLRLSCAASGFTFDDSAMHWVRQAPGKGLEWVSGISWNSGNMEYADSVKGRFTISRDNAKNSLYLQMNSLRAEDTALYYCAKDRRFGELLGVYDNWGQGTLVTVSS

SEQ ID NO: 4347 - protein, 15 aa, Artificial Sequence
  Synthetic
AKDRRFGELLGVYDN

SEQ ID NO: 4348 - protein, 106 aa, Artificial Sequence
  Synthetic
DIQMTQSPSTLSASVGDRVCRASQSISTWLAWYQQKPGKAPKLLIYDASSLESGVPSRFSGSGSGTEFTLTISSLQPDDFATYYCQHYNSYSLLFTFGQGTKLEIK

SEQ ID NO: 4349 - protein, 11 aa, Artificial Sequence
  Synthetic
QHYNSYSLLFT

SEQ ID NO: 4350 - protein, 123 aa, Artificial Sequence
  Synthetic
QMQLVQSGPEVKKPGTSVKVSCKASGFTFTSSAVQWVRQARGQRLEWIGWIVVGSGNTNYAQKFQERVTITRDMSTNTAYMELSSLRSEDTAVYYCAAPYCSSTSCHDGFDIWGQGTMVTVSS

SEQ ID NO: 4351 - protein, 16 aa, Artificial Sequence
  Synthetic
AAPYCSSTSCHDGFDI

SEQ ID NO: 4352 - protein, 108 aa, Artificial Sequence; identical to SEQ ID NO: 2940
  Synthetic

SEQ ID NO: 4353 - protein, 9 aa, Artificial Sequence
  Synthetic
QQYGSSPWT

SEQ ID NO: 4354 - protein, 127 aa, Artificial Sequence
  Synthetic
QVQLVESGGGVVQPGRSLRLSCAASGFTFSRYGMHWVRQAPGKGLEWVAVIWYDGSNKYYADSVKGRFTISRDTSKNTLYLQMNSLRAEDTAVYYCARASHYYDSSGLLRSDAFDIWGQGTMVTVSS

SEQ ID NO: 4355 - protein, 20 aa, Artificial Sequence
  Synthetic
ARASHYYDSSGLLRSDAFDI

SEQ ID NO: 4356 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYSFTFGPGTKVDIK

SEQ ID NO: 4357 - protein, 9 aa, Artificial Sequence
  Synthetic
QQYNSYSFT

SEQ ID NO: 4358 - protein, 126 aa, Artificial Sequence; identical to SEQ ID NO: 4278
  Synthetic

SEQ ID NO: 4359 - protein, 19 aa, Artificial Sequence
  Synthetic
AITLSGYCSSSSCSYPWGP

SEQ ID NO: 4360 - protein, 107 aa, Artificial Sequence; identical to SEQ ID NO: 4280
  Synthetic

SEQ ID NO: 4361 - protein, 9 aa, Artificial Sequence
  Synthetic
QQSYSTPFT

SEQ ID NO: 4362 - protein, 129 aa, Artificial Sequence
  Synthetic
EVQLLESGGGLVHPGGSLRLSCAASGFTFSSYAMIWVRQAPGKGLEWVSGISGSGGSTYYADSVKGRFTISRDNSKNTLYLQMNSLRAEDTAVYYCAKGLRDYDTSGYYYWAGLAFDYWGQGTLVTVSS

SEQ ID NO: 4363 - protein, 22 aa, Artificial Sequence
  Synthetic
AKGLRDYDTSGYYYWAGLAFDY

SEQ ID NO: 4364 - protein, 107 aa, Artificial Sequence
  Synthetic
DIQMTQSPSTLSASVGDRVTITCRASQSISSWLAWYQQKPGKAPNLLIYDASSLESGVPSRFSGSGSGTEFTLTISSLQPDDFATYYCQQYNSYSSTFGQGTKVEIK

SEQ ID NO: 4365 - protein, 9 aa, Artificial Sequence
  Synthetic
QQYNSYSST

SEQ ID NO: 4366 - protein, 121 aa, Artificial Sequence
  Synthetic
QVQLQESGPGLVKPSQTLSLTCTVSGGSISSGGYYWSWIRQHPGKGLEWIGNIYHSGSTYYNPSLKSRVTISVDTSMTQFSLKLTSVTAADTAVYYCARDFGGNSNYFDYWGQGTLVTVSS

SEQ ID NO: 4367 - protein, 13 aa, Artificial Sequence
  Synthetic
ARDFGGNSNYFDY

SEQ ID NO: 4368 - protein, 106 aa, Artificial Sequence
  Synthetic
DIQMTQSPSSLSASVGDRVTITCQARQDISNYISWYQQKSKAPKLLIYDASNLETGVPSRFSGSGSGTDFTFTISSLQPEDIATYYCQQYDNLPLTFGGGTKVEIK

SEQ ID NO: 4369 - protein, 9 aa, Artificial Sequence
  Synthetic
QQYDNLPLT

SEQ ID NO: 4370 - protein, 125 aa, Artificial Sequence
  Synthetic
QVQLQESGPGLVKPSQTLSLTCTVSGNSISSGGYYWSWIRQHPGKGLECIGYIYYSGSTYYNPSLKSRVTISVDASKNQFSLKLSSVTAADTAVYYCARERAGGPPGDHNYFDSWGQGTLVTVSS

SEQ ID NO: 4371 - protein, 17 aa, Artificial Sequence
  Synthetic
ARERAGGPPGDHNYFDS

SEQ ID NO: 4372 - protein, 112 aa, Artificial Sequence
  Synthetic
DIVMTQSPLSLPVTPGEPASISCRSSQNLLHSNGYNYLDWYLQKPGQSPQLLIYLGSNRSSGVPDRFSGSGSGTDFTLKISRVEAEDVGVYYCMQALQTPPTFGQGTKVEIK

SEQ ID NO: 4373 - protein, 9 aa, Artificial Sequence
  Synthetic
MQALQTPPT

SEQ ID NO: 4374 - protein, 118 aa, Artificial Sequence
  Synthetic
EVQLVQSGAEVKKPGESLKISCKGSGYSFTTYWIGWVRQMPGKGLEWMGIIHPGDSDTRYSPSFQGQVTISADKSISTAYLQWSSLKASDTAMYYCAMTYSGDYFDYWGQGSLVTVSS

SEQ ID NO: 4375 - protein, 11 aa, Artificial Sequence
  Synthetic
AMTYSGDYFDY

SEQ ID NO: 4376 - protein, 107 aa, Artificial Sequence
  Synthetic
DIQMTQSPSTLSASVGDRVTITCRASQSISSWLAWYQQKPGKAPVLLIYKASNLESGVPSRFSGSGSGTEFTLSISSLQPDDFATYYCQQYNSYSWTFGQGTKVEIK

SEQ ID NO: 4377 - protein, 9 aa, Artificial Sequence
  Synthetic
QQYNSYSWT

SEQ ID NO: 4378 - protein, 120 aa, Artificial Sequence
  Synthetic
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARQWGQLAAFDYWGQGTLVTVSS

SEQ ID NO: 4379 - protein, 12 aa, Artificial Sequence
  Synthetic
ARQWGQLAAFDY

SEQ ID NO: 4380 - protein, 107 aa, Artificial Sequence
  Synthetic
AIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 4381 - protein, 9 aa, Artificial Sequence
  Synthetic
QQFNNYPLT

SEQ ID NO: 4382 - protein, 117 aa, Artificial Sequence
  Synthetic
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDRTELLDYWGQGTLVTVSS

SEQ ID NO: 4383 - protein, 10 aa, Artificial Sequence
  Synthetic
ARDRTELLDY

SEQ ID NO: 4384 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYPHTFGQGTKLEIK

SEQ ID NO: 4385 - protein, 9 aa, Artificial Sequence
  Synthetic
QQYNSYPHT

SEQ ID NO: 4386 - protein, 119 aa, Artificial Sequence
  Synthetic
QVQLQQWGAGLLKPSETLSRTCAVYGGSFSGYYWTWIRQPPGKGPEWIGEINHIGITNYNPSLKSRVTISVDTSKNQFSLRLTSVTAADTAVYYCVRSCGGDCRHLDSWGQGTLVTVSS

SEQ ID NO: 4387 - protein, 13 aa, Artificial Sequence
  Synthetic
VRSCGGDCRHLDS

SEQ ID NO: 4388 - protein, 111 aa, Artificial Sequence
  Synthetic
DIVMTQTPLSSPVTLGQSASVSCRSSQSLVHSDGNTYLSWLQQRPGQPPRLLIYKISNRFSGVPDRFSGSGAGTDFTLKISRVEAEDVGIYYCMQATQSITFGQGTRLEIE

SEQ ID NO: 4389 - protein, 8 aa, Artificial Sequence
  Synthetic
MQATQSIT

SEQ ID NO: 4390 - protein, 118 aa, Artificial Sequence
  Synthetic
EVQLVESGGGLIQPGGSLRLSCAASGITVSSNYMSWVRQAPGKGLEWVSVIYAGGSTYYADSVKGRFTISRDNSKNTLYLQMNSLRAEDTAVYYCARDLDIAGALDIWGQGTMVTVSS

SEQ ID NO: 4391 - protein, 12 aa, Artificial Sequence
  Synthetic
ARDLDIAGALDI

SEQ ID NO: 4392 - protein, 108 aa, Artificial Sequence
  Synthetic
DIQLTQSPSFLSASVGDRVTITCRASQGISNYLAWYQQKPGKAPKLLIYAASTLQSGVPSRFSGSGSGTDFTLTISSLQPEDFATYYCQQLNSYPRLAFGGGTKVEIK

SEQ ID NO: 4393 - protein, 10 aa, Artificial Sequence
  Synthetic
QQLNSYPRLA

SEQ ID NO: 4394 - protein, 125 aa, Artificial Sequence
  Synthetic
EVQLVESGGGLVQPGGSLRLSCAASGFTFSSYDMHWVRQATGEGLEWVSAIGTAGDTYYPDSVKGRFTISRENAKNSLYLQMNSLRAGDTAVYYCARVEYSSGSRFSSYWYFDLWGRGTLVTVSS

SEQ ID NO: 4395 - protein, 19 aa, Artificial Sequence
  Synthetic
ARVEYSSGSRFSSYWYFDL

SEQ ID NO: 4396 - protein, 108 aa, Artificial Sequence; identical to SEQ ID NO: 142
  Synthetic

SEQ ID NO: 4397 - protein, 10 aa, Artificial Sequence
  Synthetic
QQSYSTPPWT

SEQ ID NO: 4398 - protein, 121 aa, Artificial Sequence
  Synthetic
QVQLQESGPGLVKPSQTLSLTCTVSGGSITSGGFYWSWIRQHPGKGLEWIGNIYYSGSTYYNPSLKSRVTISVDTSKNQFSLKLSSVTAADTAVYYCARDYGGNSNYFGYWGQGTLVTVSS

SEQ ID NO: 4399 - protein, 13 aa, Artificial Sequence
  Synthetic
ARDYGGNSNYFGY

SEQ ID NO: 4400 - protein, 107 aa, Artificial Sequence
  Synthetic
DIQMTQSPSSLSASVGDRVTITCQARQDISNYISWYQQKSGKAPKLLIYDASNLETGVPSRFSGSGSGTDFTFTISSLQPEDIATYYCQQYDNLPLTFGGGTKVEIK

SEQ ID NO: 4401 - protein, 9 aa, Artificial Sequence
  Synthetic
QQYDNLPLT

SEQ ID NO: 4402 - protein, 118 aa, Artificial Sequence
  Synthetic
EVQLVESGGGLIQPGGSLRLSCAASGLTVSRNYMNWVRQAPGKGLEWVSVIYSGGSTYYADSVKGRFTISRDNSKNTLYLQMNSLRAEDTAVYYCARDLEIAGAFDIWGQGTMVTVSS

SEQ ID NO: 4403 - protein, 12 aa, Artificial Sequence
  Synthetic
ARDLEIAGAFDI

SEQ ID NO: 4404 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLNSYPITFGQGTRLEIK

SEQ ID NO: 4405 - protein, 9 aa, Artificial Sequence
  Synthetic
QQLNSYPIT

SEQ ID NO: 4406 - protein, 125 aa, Artificial Sequence
  Synthetic
QVQLVQSGAEVKKPGSSVKVSCKASGGTFSSYAISWVRQAPGQGLEWMGRIIPLLGIANYAQKFQGRVTITADKSTRTAYMELSSLISEDTAVYYCARVKYSSSLGEGLDAFDIWGQGTMVTVSS

SEQ ID NO: 4407 - protein, 18 aa, Artificial Sequence
  Synthetic
ARVKYSSSLGEGLDAFDI

SEQ ID NO: 4408 - protein, 108 aa, Artificial Sequence
  Synthetic
DIQMTQSPSTLSASVGDRVTITCRASQSINSWLAWYQQKPGKAPKLLIYDASSLESGVPSRFSGSGSGTEFTLTISSLQPDDFATYYCQQYNSYSPLTFGGGTKVEIK

SEQ ID NO: 4409 - protein, 10 aa, Artificial Sequence
  Synthetic
QQYNSYSPLT

SEQ ID NO: 4410 - protein, 118 aa, Artificial Sequence
  Synthetic
EVQLVESGGGLIQPGGSLRLSCAASGITVSRNYMSWVRQAPGKGLEWVSVIYSGGTTYYADSVKGRFTISRDNSKNTLYLQMNSMRAEDTAVYYCARDLIEAGGMDVWGQGTTVTVSS

SEQ ID NO: 4411 - protein, 12 aa, Artificial Sequence
  Synthetic
ARDLIEAGGMDV

SEQ ID NO: 4412 - protein, 107 aa, Artificial Sequence
  Synthetic
DIQMTQSPSTLSASVGDRVTITCRASQSISTWLAWYQQKPGKAPKLLIYDASSLKSGVPSRFSGSGSGTEFTLTISSLQPDDFATYYCQQYTSYPYTFGQGTKLEIK

SEQ ID NO: 4413 - protein, 9 aa, Artificial Sequence
  Synthetic
QQYTSYPYT

SEQ ID NO: 4414 - protein, 124 aa, Artificial Sequence
  Synthetic
QVQLVESGGGVVQPGRSLRLSCAASGFTFSSYGMHWVRQAPGKGLEWVAVIWYDGSNKFYADSVKGRFTISRDNSKNTLYLQMNSLRAEDTAVYYCARDQTDMTTVTADAFDIWGQGTMVTVSS

SEQ ID NO: 4415 - protein, 17 aa, Artificial Sequence
  Synthetic
ARDQTDMTTVTADAFDI

SEQ ID NO: 4416 - protein, 108 aa, Artificial Sequence
  Synthetic
DIQMTQSPSSLSASVGDRVTITCRASQSISRYLNWYQQKPGKAPKLLIYAASSLQSGVPSRFSGSGSGTDFTLTISSLQPEDFATYYCQQTYSTPPITFGQGTRLEIK

SEQ ID NO: 4417 - protein, 10 aa, Artificial Sequence
  Synthetic
QQTYSTPPIT

SEQ ID NO: 4418 - protein, 120 aa, Artificial Sequence
  Synthetic
EVQLLESGGGLVQPGGSLRLSCAASGFTFSRYAVSWVRQAPGKGLEWVSSISGSGGSTYYADSVKGRFTISRDNSKNTLYLQMNSLRAEDTAVYYCAKAPRSNSDYFDFWGQGTLVTVSS

SEQ ID NO: 4419 - protein, 13 aa, Artificial Sequence
  Synthetic
AKAPRSNSDYFDF

SEQ ID NO: 4420 - protein, 107 aa, Artificial Sequence
  Synthetic
DIQMTQSPSTLSASVGDRVSITCRASQSISSWLAWYQQKPGKAPKLLIYDASSLESGVPSRFSGSGSGTEFTLTISSLQPDDFATYYCQQYNSYSPTFGQGTKVVIK

SEQ ID NO: 4421 - protein, 9 aa, Artificial Sequence
  Synthetic
QQYNSYSPT

SEQ ID NO: 4422 - protein, 132 aa, Artificial Sequence
  Synthetic
EVQLVESGGGLVQPGGSLRLSCAASGFTFSSYWMSWVRQAPGKGLEWVADIKQDGSEKYYVDSVKGRFTISRDNAKNSLYLQMNSLRAEDTAVYYCARDGGPNYYDSSGYYYDYYYYGMDVWGQGTTVTVSS

SEQ ID NO: 4423 - protein, 25 aa, Artificial Sequence
  Synthetic
ARDGGPNYYDSSGYYYDYYYYGMDV

SEQ ID NO: 4424 - protein, 107 aa, Artificial Sequence
  Synthetic
DIQMTQSPSSLSASVGDRVTITCRASQSISSYLNWYQQKPGKAPKLLIYAASSLQRGVPSRFSGSGSGTDFTLTISSLQPEDFATYYCQQSYSTPWTFGQGTKVEIK

SEQ ID NO: 4425 - protein, 9 aa, Artificial Sequence
  Synthetic
QQSYSTPWT

SEQ ID NO: 4426 - protein, 127 aa, Artificial Sequence; identical to SEQ ID NO: 4318
  Synthetic

SEQ ID NO: 4427 - protein, 21 aa, Artificial Sequence
  Synthetic
ARGRPENIAGHYDSWSGSVEI

SEQ ID NO: 4428 - protein, 107 aa, Artificial Sequence; identical to SEQ ID NO: 4320
  Synthetic

SEQ ID NO: 4429 - protein, 8 aa, Artificial Sequence
  Synthetic
QQYGGSFT

SEQ ID NO: 4430 - protein, 120 aa, Artificial Sequence
  Synthetic
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDPRYNWNYGEFWGQGTLVTVSS

SEQ ID NO: 4431 - protein, 13 aa, Artificial Sequence
  Synthetic
AKDPRYNWNYGEF

SEQ ID NO: 4432 - protein, 108 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYSSYTFGQGTKLEIK

SEQ ID NO: 4433 - protein, 10 aa, Artificial Sequence
  Synthetic
QQYNSYSSYT

SEQ ID NO: 4434 - protein, 126 aa, Artificial Sequence
  Synthetic
EVQLVESGGGLVKPGGSLRLSCAASGFTFTSYSMNWVRQAPGKGPEWVSSISGSGTHIYYVDSVRGRFTISRDNAKDSLYLQMNSLRAEDTAVYYCAITLSGYCSSTSCSYPWGPWGQGTLVTVSS

SEQ ID NO: 4435 - protein, 19 aa, Artificial Sequence
  Synthetic
AITLSGYCSSTSCSYPWGP

SEQ ID NO: 4436 - protein, 107 aa, Artificial Sequence
  Synthetic
DIQMTQSPSSLSASVGDRVTITCRASQNIHSYLNWYQQKPGKPPNLLIYGASSLQSGVPSSFSGSGSGTEFTLTISSLQPEDFATYYCQQSYSTPFTFGPGTKVDIK

SEQ ID NO: 4437 - protein, 9 aa, Artificial Sequence
  Synthetic
QQSYSTPFT

SEQ ID NO: 4438 - protein, 118 aa, Artificial Sequence
  Synthetic
EVQLVESGGGLIQPGGSLRLSCAASGLTVSSNYMSWVRQAPGKGLEWVSVIYSGGSTYYADSVKGRFTISRDNSKNTLYLQMNSLRAEDTAVYYCARDLGPRGGMDVWGQGTTVTVSS

SEQ ID NO: 4439 - protein, 12 aa, Artificial Sequence
  Synthetic
ARDLGPRGGMDV

SEQ ID NO: 4440 - protein, 107 aa, Artificial Sequence
  Synthetic
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPYTFGQGTKLEIK

SEQ ID NO: 4441 - protein, 9 aa, Artificial Sequence
  Synthetic
LQDYNYPYT

SEQ ID NO: 4442 - protein, 125 aa, Artificial Sequence
  Synthetic
QVQLVESGGGVVQPGRSLRLSCAASGFTFSSYAMHWVRQVPGKGLEWVAVISYDGSNKDYADSVKGRFTISRDNSKNTLYLQMNSLRAEDTAVYYCARDSSGYYYEPRGGAFDIWGQGTMVTVSS

SEQ ID NO: 4443 - protein, 18 aa, Artificial Sequence
  Synthetic
ARDSSGYYYEPRGGAFDI

SEQ ID NO: 4444 - protein, 107 aa, Artificial Sequence
  Synthetic
DIQMTQSPSSLSASVGDRVTITCRASQSISSYLNWYQQKPGKAPKLLIYAASSLKSGVPSRFSGSGSGTDFTLTISSLQPEDFATYYCQQSYSTPNTFGQGTKLEIK

SEQ ID NO: 4445 - protein, 9 aa, Artificial Sequence
  Synthetic
QQSYSTPNT

SEQ ID NO: 4446 - protein, 121 aa, Artificial Sequence
  Synthetic
EVQLVESGGGLVQPGGSLRLSCAASGFTFSSYDMHWVRQVTGKGLEWVSAIGTAGDTYYPDSVKGRFTISRENAKNSLYLQMNSLRAGDTAVYYCARGGEDYHGAWYFDLWGRGTLVTVSS

SEQ ID NO: 4447 - protein, 15 aa, Artificial Sequence
  Synthetic
ARGGEDYHGAWYFDL

SEQ ID NO: 4448 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTHFTLTISSLKPEDFATYYCQQSYSMPPITFGQGTRLEIK

SEQ ID NO: 4449 - protein, 10 aa, Artificial Sequence
  Synthetic
QQSYSMPPIT

SEQ ID NO: 4450 - protein, 120 aa, Artificial Sequence
  Synthetic
QVQLVESGGGVVQPGRSLRLSCAASGFTFSSYGMHWVRQAPGKGLEWVAVIWSDGSIKYYADSVKGRFTISRDNSKNTLYLQMNTLRAEDTAVYHCARGPRPNGDYGEYWGQGTLVTVSS

SEQ ID NO: 4451 - protein, 13 aa, Artificial Sequence
  Synthetic
ARGPRPNGDYGEY

SEQ ID NO: 4452 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYLFTFGPGTKVDIK

SEQ ID NO: 4453 - protein, 9 aa, Artificial Sequence
  Synthetic
QQYNSYLFT

SEQ ID NO: 4454 - protein, 121 aa, Artificial Sequence
  Synthetic
EVQLVESGGGMVQPGRSLRLSCAASGFTFDDFAMHWVRQAPGKGLEWISAISWNSGRIAYADSVKGRFTISRDNPKNSLYLQMNSLRPEDTALYYCAKDVSPYGYYHMDVWGKGTTVTVSS

SEQ ID NO: 4455 - protein, 14 aa, Artificial Sequence
  Synthetic
AKDVSPYGYYHMDV

SEQ ID NO: 4456 - protein, 112 aa, Artificial Sequence
  Synthetic
DIVMTQTPLSLSVTPGQPASISCKSNQSLLHSDGRTHLYWYLQKPGHSPQLLIYEVSNRFSGVPDRFSGSGSGTDFTLKISRVEAEDVGFYYCMQTIQLPLTFGGGTKVEIK

SEQ ID NO: 4457 - protein, 9 aa, Artificial Sequence
  Synthetic
MQTIQLPLT

SEQ ID NO: 4458 - protein, 114 aa, Artificial Sequence; identical to SEQ ID NO: 4286
  Synthetic

SEQ ID NO: 4459 - protein, 8 aa, Artificial Sequence
  Synthetic
ARDFKDEA

SEQ ID NO: 4460 - protein, 107 aa, Artificial Sequence; identical to SEQ ID NO: 2880
  Synthetic

SEQ ID NO: 4461 - protein, 9 aa, Artificial Sequence
  Synthetic
QQYDNLPRT

SEQ ID NO: 4462 - protein, 120 aa, Artificial Sequence
  Synthetic
EVQLLESGGALVQPGGSLRLSCAASGFTFSRYAMSWVRQAPGKGLEWVSGIGGDGAITHYADSVKGRFTISRDNSKNTLYLQMNSLRAEDTAVYYCAKGPRHEGDYFDYWGQGTLVTVSS

SEQ ID NO: 4463 - protein, 13 aa, Artificial Sequence
  Synthetic
AKGPRHEGDYFDY

SEQ ID NO: 4464 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYGYTFGQGTKLEIK

SEQ ID NO: 4465 - protein, 9 aa, Artificial Sequence
  Synthetic
QQYNSYGYT

SEQ ID NO: 4466 - protein, 125 aa, Artificial Sequence
  Synthetic
QVQLVQSGAEVKKPGSSVKVSCKASGGTFSSHGINWVRQAPGQGLEWMGRIIPILGIANHAQKLQGRVTITADKSTSTAYMELSSLRSEDTAVYYCARVKYSSSLGEGLDAFDIWGQGTMVTVSS

SEQ ID NO: 4467 - protein, 18 aa, Artificial Sequence
  Synthetic
ARVKYSSSLGEGLDAFDI

SEQ ID NO: 4468 - protein, 108 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYSPLTFGGGTKVEIK

SEQ ID NO: 4469 - protein, 10 aa, Artificial Sequence
  Synthetic
QQYNSYSPLT

SEQ ID NO: 4470 - protein, 114 aa, Artificial Sequence; identical to SEQ ID NO: 4286
  Synthetic

SEQ ID NO: 4471 - protein, 8 aa, Artificial Sequence
  Synthetic
ARDFKDEA

SEQ ID NO: 4472 - protein, 107 aa, Artificial Sequence; identical to SEQ ID NO: 2880
  Synthetic

SEQ ID NO: 4473 - protein, 9 aa, Artificial Sequence
  Synthetic
QQYDNLPRT

SEQ ID NO: 4474 - protein, 125 aa, Artificial Sequence
  Synthetic
QVQLQESGPGLVKPSETLSLTCAVSGGSISTYYWSWIRQPPGKGLEWIGYMYYSGNTKYNPSLKSRLTISVDTSKNQFSLKLSSVTAADTAVYYCARGGPPLDGGNSPEGAFDVWGQGTMVTVSS

SEQ ID NO: 4475 - protein, 19 aa, Artificial Sequence
  Synthetic
ARGGPPLDGGNSPEGAFDV

SEQ ID NO: 4476 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYFCQQYNSYPYTFGQGTKLEIK

SEQ ID NO: 4477 - protein, 9 aa, Artificial Sequence
  Synthetic
QQYNSYPYT

SEQ ID NO: 4478 - protein, 126 aa, Artificial Sequence
  Synthetic
QVQLVQSGAEVKKPGSSVKVSCKASGGTFSTYAINWVRQAPGQGLEWMGRIIPILNIPNYAQKFQGRVTITADPSTSTAYMELSSLRSDDTAVYYCAKSHSPLVVSAATTNWFDPWGQGTLVTVSS

SEQ ID NO: 4479 - protein, 19 aa, Artificial Sequence
  Synthetic
AKSHSPLVVSAATTNWFDP

SEQ ID NO: 4480 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYARSPLTFGGGTKVEIK

SEQ ID NO: 4481 - protein, 9 aa, Artificial Sequence
  Synthetic
QQYARSPLT

SEQ ID NO: 4482 - protein, 123 aa, Artificial Sequence
  Synthetic
QVQLVQSGAEVKKPGSSVKVSCKASGGTFSSYAISWVRQAPGQGLEWMGRFIPMRVIANYAQKFQGRVTITADKSTSTAYMELSSLRSEDTAVYYCARVLLTGSLSHEAFDMWGQGTMVTVSS

SEQ ID NO: 4483 - protein, 16 aa, Artificial Sequence
  Synthetic
ARVLLTGSLSHEAFDM

SEQ ID NO: 4484 - protein, 106 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYITFGGGTKVEIK

SEQ ID NO: 4485 - protein, 8 aa, Artificial Sequence
  Synthetic
QQYNSYIT

SEQ ID NO: 4486 - protein, 118 aa, Artificial Sequence
  Synthetic
EVQLVESGGGLIQPGGSLRLSCAASGFTVSSNYMSWVRQAPGKGLEWVSVIYSGGSTYYADSVKGRFTISRDNSKNTLYLQMKSLRAEDTAVYYCARDLQEYAGMDVWGQGTTVTVSS

SEQ ID NO: 4487 - protein, 12 aa, Artificial Sequence
  Synthetic
ARDLQEYAGMDV

SEQ ID NO: 4488 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYSNTFGQGTKLEIK

SEQ ID NO: 4489 - protein, 9 aa, Artificial Sequence
  Synthetic
QQYNSYSNT

SEQ ID NO: 4490 - protein, 122 aa, Artificial Sequence
  Synthetic
QVQLVQSGAEVKKPGASVKVSCKASGYTFTTYYMHWVRQAPGQGLEWMGIINPSGGSTSYAQKFQGRVTMTRDTSTSTVYMELSSLRSEDTAVYYCARGGIPVNLKYSFDYWGQGTLVTVSS

SEQ ID NO: 4491 - protein, 15 aa, Artificial Sequence
  Synthetic
ARGGIPVNLKYSFDY

SEQ ID NO: 4492 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYKSYSVTFGQGTKVEIK

SEQ ID NO: 4493 - protein, 9 aa, Artificial Sequence
  Synthetic
QQYKSYSVT

SEQ ID NO: 4494 - protein, 120 aa, Artificial Sequence
  Synthetic
EVQLLESGGGLIQPGGSLRLSCATSGFIFSSYAMSWVRQAPGKGLEWVSAISGSGGSTYYADSVKGRFTISRDNSKNTLYLQMNSLRAEDTAVYYCAKGPRGSYDYFEYWGQGTLVTVSS

SEQ ID NO: 4495 - protein, 13 aa, Artificial Sequence
  Synthetic
AKGPRGSYDYFEY

SEQ ID NO: 4496 - protein, 106 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQFSSYATFGQGTKVEIK

SEQ ID NO: 4497 - protein, 8 aa, Artificial Sequence
  Synthetic
QQFSSYAT

SEQ ID NO: 4498 - protein, 120 aa, Artificial Sequence
  Synthetic
EVQLVESGGGLVQPGGSLRLSCAASGFTFRSYWMHWVRQAPGKGLVWVSRIDSDGSSTSYADSVKGRFTISRDNAKNTLYLQMNSLRAEDTAVYYCARGYCGGDCPVDYWGPGTLVTVSS

SEQ ID NO: 4499 - protein, 13 aa, Artificial Sequence
  Synthetic
ARGYCGGDCPVDY

SEQ ID NO: 4500 - protein, 107 aa, Artificial Sequence
  Synthetic
DIQMTQSPSTLSASVGDRVTITCRASQSISSWLAWYQQKPGKAPKFLIYDASNLESGVPSRFSGSGSGTEFTLTISSLQPDDFATYYCQHYNSYPWTFGQGTKVEIK

SEQ ID NO: 4501 - protein, 9 aa, Artificial Sequence
  Synthetic
QHYNSYPWT

SEQ ID NO: 4502 - protein, 126 aa, Artificial Sequence
  Synthetic
EVQLVESGGGLVQPGRSLRLSCAASGFTFDDYAMHWVRQAPGKGLEWVSGIRWNSGSKGYADSVKGRFTISRDNAKNSLYLQMNSLRAEDTALYYCAKGDMIIFGGVIAGGAFDIWGQGTMVTVSS

SEQ ID NO: 4503 - protein, 19 aa, Artificial Sequence
  Synthetic
AKGDMIIFGGVIAGGAFDI

SEQ ID NO: 4504 - protein, 107 aa, Artificial Sequence
  Synthetic
EIVLTQSPGTLSLSGERATLSCRASQTVSADYLAWYQQKPGQAPRLLIYGASSRATGIPDRFSGSGSGTDFTLTISRLEPEDFAVYYCQQYGSSPPTFGQGTKVEIK

SEQ ID NO: 4505 - protein, 9 aa, Artificial Sequence
  Synthetic
QQYGSSPPT

SEQ ID NO: 4506 - protein, 119 aa, Artificial Sequence
  Synthetic
EVQLVESGGGLIQPGGSLRLSCEASGFTVSRNYMIWVRQAPGKGLEWVSVIYSGGSTFYGDSVKGRFTISRDNSKNTLYLQMNSLRAEDTAVYYCARDLPDGVGGMDVWGQGTTVTVSS

SEQ ID NO: 4507 - protein, 13 aa, Artificial Sequence
  Synthetic
ARDLPDGVGGMDV

SEQ ID NO: 4508 - protein, 109 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPGYTFGQGTKLQIK

SEQ ID NO: 4509 - protein, 10 aa, Artificial Sequence
  Synthetic
QQYGSSPGYT

SEQ ID NO: 4510 - protein, 120 aa, Artificial Sequence
  Synthetic
EVQLVQSGAEVKKPGESLKISCKGSGYIFTNYWIGWVRQMPGKGLEWMGIIYSGDSDTRYSPAFRGQVTISADKSISTAYLQWSSLKASDTAMYYCARLLCGGGCPIDYWGQGTLVTVSA

SEQ ID NO: 4511 - protein, 13 aa, Artificial Sequence
  Synthetic
ARLLCGGGCPIDY

SEQ ID NO: 4512 - protein, 106 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYSTWYTFGQGTKLEIK

SEQ ID NO: 4513 - protein, 8 aa, Artificial Sequence
  Synthetic
QQYSTWYT

SEQ ID NO: 4514 - protein, 118 aa, Artificial Sequence
  Synthetic
EVQLVQSGAEVKKPGESLNISCKGSGYSFTTYWIGWVRQMPGKGLEWMGIIYPGDSETRYSPSFQGQVTISADKSISTAYLQWSSLKASDTAMFYCARSYNWNYFDYWGQGTLVTVSS

SEQ ID NO: 4515 - protein, 11 aa, Artificial Sequence
  Synthetic
ARSYNWNYFDY

SEQ ID NO: 4516 - protein, 107 aa, Artificial Sequence
  Synthetic
DIQMTQSPSTLSASVGDRVTITCRASQSISIWLAWYQRKPGKAPKFLIYDASNLESGVSSRFSGSGSGTEFTLTISSLQPDDFATYYCQQYNSYPWTFGQGTKVEIK

SEQ ID NO: 4517 - protein, 9 aa, Artificial Sequence
  Synthetic
QQYNSYPWT

SEQ ID NO: 4518 - protein, 127 aa, Artificial Sequence
  Synthetic
QVQLVESGGGVVQPGRSLRLSCAASGLTFSSYGMHWVRQAPGKGLEWVAVISYDGSNKNYADSVKGRFTISRDNSKNTLYLQMNSLRAEDTAVYYCAKQAGTYCSGGSCYEGYFDYWGQGTLVTVSS

SEQ ID NO: 4519 - protein, 20 aa, Artificial Sequence
  Synthetic
AKQAGTYCSGGSCYEGYFDY

SEQ ID NO: 4520 - protein, 109 aa, Artificial Sequence
  Synthetic
DIQMTQSPSTLSASVGDRVTITCRASQSISSWLAWYQQKPGKAPKLLISDASSLESGVPSRFSGSGSGTEFTLTISSLQPDDFATYYCQQYYSYSPMYTFGQGTKLEIK

SEQ ID NO: 4521 - protein, 11 aa, Artificial Sequence
  Synthetic
QQYYSYSPMYT

SEQ ID NO: 4522 - protein, 127 aa, Artificial Sequence
  Synthetic
QVQLVESGGGVVQPGRSLRLSCAASGFTFSTYAMHWVRQAPGKGLEWVAVISYDGSNKYYADSVKGRFTISRDNSKNTLDLQMNSLRAEDRAVYYCARDVRVVVGATSHYYNGMDVWGQGTTVTVSS

SEQ ID NO: 4523 - protein, 20 aa, Artificial Sequence
  Synthetic
ARDVRVVVGATSHYYNGMDV

SEQ ID NO: 4524 - protein, 106 aa, Artificial Sequence
  Synthetic
DIQMTQSPSSVSASVGDRVTITCRASQGISSWLAWYQQKPGKAPKLLYDASSLQSGVPSRFSGSGSGTDFTLTISSLQPEDFATYYCQQAKSFPFTFGPGTKVDIK

SEQ ID NO: 4525 - protein, 9 aa, Artificial Sequence
  Synthetic
QQAKSFPFT

SEQ ID NO: 4526 - protein, 123 aa, Artificial Sequence
  Synthetic
QVQLVESGGGLVKPGGSLRLSCAASGFTFSDYYMSWIRQAPGKGLEWVSYISTSGGSIYYADSVKGRFTISRDNAKNSLYLQLNSLRAEDTAVYYCAREWGADPNTPDDFDIWGQGTMVTVSS

SEQ ID NO: 4527 - protein, 16 aa, Artificial Sequence
  Synthetic
AREWGADPNTPDDFDI

SEQ ID NO: 4528 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKLEIK

SEQ ID NO: 4529 - protein, 9 aa, Artificial Sequence
  Synthetic
QQSYSTPPT

SEQ ID NO: 4530 - protein, 127 aa, Artificial Sequence; identical to SEQ ID NO: 4318
  Synthetic

SEQ ID NO: 4531 - protein, 21 aa, Artificial Sequence
  Synthetic
ARGRPENIAGHYDSWSGSVEI

SEQ ID NO: 4532 - protein, 107 aa, Artificial Sequence; identical to SEQ ID NO: 4320
  Synthetic

SEQ ID NO: 4533 - protein, 8 aa, Artificial Sequence
  Synthetic
QQYGGSFT

SEQ ID NO: 4534 - protein, 123 aa, Artificial Sequence
  Synthetic
QVQLVESGGGLVKPGGSLRLSCAASGFTFSDYYMNWIRQAPGKGLEWVSYISSGGSTIYYADSVKGRFTISRDNAKNSLSLQMNSLRAEDTAVYYCAREWGDDPNTPDRFDIWGQGTMVTVSS

SEQ ID NO: 4535 - protein, 16 aa, Artificial Sequence
  Synthetic
AREWGDDPNTPDRFDI

SEQ ID NO: 4536 - protein, 107 aa, Artificial Sequence
  Synthetic
DIQMTQSPSSLSASVGDRVTITCRASQSISSYLNWYLQKPGKAPKLLIYAASSLQSGVPSRFSGSGSGTDFTLTISSLQPEDFATYYCQQSYSTPPTFGQGTKLEIK

SEQ ID NO: 4537 - protein, 9 aa, Artificial Sequence
  Synthetic
QQSYSTPPT

SEQ ID NO: 4538 - protein, 127 aa, Artificial Sequence
  Synthetic
EVQLVESGGGLVKPGGSLRLSCAASGFSFNNAWMSWVRQAPGKGLEWVGRIKSKTDGGPTDYAAPVKGRFIISRDDSKNTLYLQMNSLKTEDTAVYYCTTSVIVVVAAAIDDYFDYWGQGTLVTVSS

SEQ ID NO: 4539 - protein, 18 aa, Artificial Sequence
  Synthetic
TTSVIVVVAAAIDDYFDY

SEQ ID NO: 4540 - protein, 108 aa, Artificial Sequence
  Synthetic
DIQMTQSPSSLSASVGDRVTITCRASQTISRNLNWYQQKPGKAPKLLIFAASSLQSGVPSRFSGSGSGTDFTLTISSLQPEDFATYYCQQSYSTPPHTFGQGTKLEIK

SEQ ID NO: 4541 - protein, 10 aa, Artificial Sequence
  Synthetic
QQSYSTPPHT

SEQ ID NO: 4542 - protein, 120 aa, Artificial Sequence
  Synthetic
EVQLLESGGGLVQPGGSLRLSCAASRFTFSRYAMTWVRQGPGKGLEWVSDISGSGDSTYYADSVKGRFTISRDNSKNTLYLQMNSLRAEDTAVYYCAKGARENGDYNDYWGQGTLVTVSS

SEQ ID NO: 4543 - protein, 13 aa, Artificial Sequence
  Synthetic
AKGARENGDYNDY

SEQ ID NO: 4544 - protein, 107 aa, Artificial Sequence
  Synthetic
DIQMTQSPSSLSASVGDRVTITCRASQGISNYLAWFQQKPGKAPKSLIYAASSLQSGVPSRFSGSGSGTEFTLTISSLQPDDFAAYYCQQYNSYPYTFGQGTKLEIK

SEQ ID NO: 4545 - protein, 9 aa, Artificial Sequence
  Synthetic
QQYNSYPYT

SEQ ID NO: 4546 - protein, 120 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGPRANGDYLEYWGQGTLVTVSS

SEQ ID NO: 4547 - protein, 13 aa, Artificial Sequence
  Synthetic
AKGPRANGDYLEY

SEQ ID NO: 4548 - protein, 106 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYYTFGQGTKLEIK

SEQ ID NO: 4549 - protein, 8 aa, Artificial Sequence
  Synthetic
QQYNSYYT

SEQ ID NO: 4550 - protein, 129 aa, Artificial Sequence
  Synthetic
QVQLVQSGAEVKKPGSSVKVSCKASGGTFSTYGISWVRQAPGQGLEWMGVIIPMFGTATYAQKFQGRVTITADESPSTAYMELSSLRSEDTAVYYCARVRVEIVVQPAPLKSHYGMDVWGQGTTVTVSS

SEQ ID NO: 4551 - protein, 22 aa, Artificial Sequence
  Synthetic
ARVRVEIVVQPAPLKSHYGMDV

SEQ ID NO: 4552 - protein, 112 aa, Artificial Sequence
  Synthetic
DIVMTQSPLSLPVTPGEPASISCRSSQSLLHSNGHNYLDWYLQKPGQSPQLLIYLGSNRASGVPDRFSGSGSGTDFTLKISRVEAEDVGVYYCMQALQTSLTFGGGTKVEIK

SEQ ID NO: 4553 - protein, 9 aa, Artificial Sequence
  Synthetic
MQALQTSLT

SEQ ID NO: 4554 - protein, 118 aa, Artificial Sequence
  Synthetic
EVQLVQSGAEVKKPGESLKISCKGSEYSFTRYWIGWVRQMPGKGLEWMGIIYPGDSDTRYSPSFQGQVTISADKSISTAYLQWSSLKASDTAMYYCATTVTTNYFDYWGQGTLVTVSS

SEQ ID NO: 4555 - protein, 11 aa, Artificial Sequence
  Synthetic
ATTVTTNYFDY

SEQ ID NO: 4556 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSYFWTFGQGTKVEIK

SEQ ID NO: 4557 - protein, 9 aa, Artificial Sequence
  Synthetic
QQYNSYFWT

SEQ ID NO: 4558 - protein, 126 aa, Artificial Sequence; identical to SEQ ID NO: 4278
  Synthetic

SEQ ID NO: 4559 - protein, 19 aa, Artificial Sequence
  Synthetic
AITLSGYCSSSSCSYPWGP

SEQ ID NO: 4560 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTEFTLTISSLQPEDFATYYCQQSYSTPFTFGPGTKVDIK

SEQ ID NO: 4561 - protein, 9 aa, Artificial Sequence
  Synthetic
QQSYSTPFT

SEQ ID NO: 4562 - protein, 123 aa, Artificial Sequence
  Synthetic
QVQLVESGGGVVQPGRSLRLSCAASGFTFSSYGMHWVRQAPGKGLEWVAVISYDGSFKYYADSVKGRFTISRDNSKNTLYLQMNSLRAEDTAVYYCARDESKDTAMVTLFDYWGQGTLVTVSS

SEQ ID NO: 4563 - protein, 16 aa, Artificial Sequence
  Synthetic
ARDESKDTAMVTLFDY

SEQ ID NO: 4564 - protein, 108 aa, Artificial Sequence; identical to SEQ ID NO: 142
  Synthetic

SEQ ID NO: 4565 - protein, 10 aa, Artificial Sequence
  Synthetic
QQSYSTPPWT

SEQ ID NO: 4566 - protein, 127 aa, Artificial Sequence
  Synthetic
QVQLVESGGGVVQPGRSLRLSCAASGFTFSTYGLHWVRQAPGKGLEWVAVISYDGGNKYSADSVKGRFTISRDNSKNTLYLQMNSLRAEDTAVYYCAKVVGGYCSGGSCYSGSFDYWGQGTLVTVSS

SEQ ID NO: 4567 - protein, 20 aa, Artificial Sequence
  Synthetic
AKVVGGYCSGGSCYSGSFDY

SEQ ID NO: 4568 - protein, 106 aa, Artificial Sequence
  Synthetic
DIQMTQSPSTLSASVGDRVTITCRASQSISSWLAWYQQKPGKAPKPLIYDASSLESGVPSRFSGSGSGTEFTLTISSLQPDDFATYYCQQYNSYVSFGQGTKVEIK

SEQ ID NO: 4569 - protein, 8 aa, Artificial Sequence
  Synthetic
QQYNSYVS

SEQ ID NO: 4570 - protein, 123 aa, Artificial Sequence
  Synthetic
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDGGYDSDAFDIWGQGTMVTVSS

SEQ ID NO: 4571 - protein, 13 aa, Artificial Sequence
  Synthetic
ARDGGYDSDAFDI

SEQ ID NO: 4572 - protein, 108 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYTNWLLYTFGQGTKLEIK

SEQ ID NO: 4573 - protein, 10 aa, Artificial Sequence
  Synthetic
QQYTNWLLYT

SEQ ID NO: 4574 - protein, 118 aa, Artificial Sequence
  Synthetic
EVQLVESGGGLIQPGGSLRLSCAASGLTVSSNYMSWVRQAPGKGLEWVSVIYSGGSTYYADSVKGRFTISRDNSKNTLYLQMNSLRAEDTAVYYCARDLEIAGAFDIWGQGTMVTVSS

SEQ ID NO: 4575 - protein, 12 aa, Artificial Sequence
  Synthetic
ARDLEIAGAFDI

SEQ ID NO: 4576 - protein, 106 aa, Artificial Sequence
  Synthetic
DIQLTQSPSFLSASVDRVTITCRASQGISSYLAWYQQKPGKAPKLLIYAASTLQSGVPSRFSGSGSGTDFTLTISSLQPEDFATYYCQQLNSYPITFGQGTRLEIK

SEQ ID NO: 4577 - protein, 9 aa, Artificial Sequence
  Synthetic
QQLNSYPIT

SEQ ID NO: 4578 - protein, 122 aa, Artificial Sequence
  Synthetic
QVQLVQSGAEVKKPGASVKVSCKASGYTFTSYYVHWVRQAPGQGLEWMGIINPSGGSTTYAQKFQGRVTMTSDTSTSTVYMDLSSLRSEDTAVYYCARDWAFIPAAGPFDYWGQGTLVTVSS

SEQ ID NO: 4579 - protein, 15 aa, Artificial Sequence
  Synthetic
ARDWAFIPAAGPFDY

SEQ ID NO: 4580 - protein, 107 aa, Artificial Sequence
  Synthetic
EIVLTQSPGTLSLSPGERATLSCRASQSVSSHYLAWYQQKPGQAPRLLIYGASSRATGIPDRFSGSGSGTDFTLTISRLEPEDFAVYYCQQYGSSWTFGQGTKVEIK

SEQ ID NO: 4581 - protein, 8 aa, Artificial Sequence
  Synthetic
QQYGSSWT

SEQ ID NO: 4582 - protein, 117 aa, Artificial Sequence
  Synthetic
EVQLVESGGGLMQPGGSLRLSCAASGLIVSSNYMSWVRQAPGKGLEWVSVIFSGGSTFYGDSVKGRFTISRDNSKNTLYLQMNSLRAEDTAVYYCAREVAGGAFDIWGQGTMVTVSS

SEQ ID NO: 4583 - protein, 11 aa, Artificial Sequence
  Synthetic
AREVAGGAFDI

SEQ ID NO: 4584 - protein, 105 aa, Artificial Sequence
  Synthetic
DIQLTQSPSFLSASVGDRVTITCRASQGISSYLAWYQQKPGKAPKLLIYAASTLQSGVPSRFSGSGGTDFTLTISLQPEDFATYYCQHLNSYPPTFGGGTKVEIK

SEQ ID NO: 4585 - protein, 9 aa, Artificial Sequence
  Synthetic
QHLNSYPPT

SEQ ID NO: 4586 - protein, 114 aa, Artificial Sequence
  Synthetic
EVQLVESGGGLVQPGGSLRLSCAASGFTVSSNYMRWVRQAPGKGLEWVSVIYSGGSTYYADSVKGRFTISRDNSKNTLYLQMNSLRAEDTAVYYCAMYSSSPLWGQGTLVTVSS

SEQ ID NO: 4587 - protein, 8 aa, Artificial Sequence
  Synthetic
AMYSSSPL

SEQ ID NO: 4588 - protein, 107 aa, Artificial Sequence
  Synthetic
DIQMTQSPSTLSASVGDRVTITCRASQSISSWLAWYQQKPGKAPKLLIYDASSLESGVPSRFSGSGSGTEFTLTISSLQPDDFATYYCQQYNSDPWTFGQGTKVEIK

SEQ ID NO: 4589 - protein, 9 aa, Artificial Sequence
  Synthetic
QQYNSDPWT

SEQ ID NO: 4590 - protein, 119 aa, Artificial Sequence
  Synthetic
EVQLVESGGGLIQPGGSLRLSCAASGFTVSSNYMSWVRQAPGKGLEWVSVIYSGGSTFYADSVKGRFTISRDNSKNTLYLQMISLRAEDTAVYYCARGGMSSEDAFDIWGQGTMVTVSS

SEQ ID NO: 4591 - protein, 13 aa, Artificial Sequence
  Synthetic
ARGGMSSEDAFDI

SEQ ID NO: 4592 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLNSYPPGTFGGGTKVEIK

SEQ ID NO: 4593 - protein, 10 aa, Artificial Sequence
  Synthetic
QQLNSYPPGT

SEQ ID NO: 4594 - protein, 129 aa, Artificial Sequence
  Synthetic
QVQLVQSGAGVKKPGSSVKVSCKASRGTFRNYAISWVRQAAGQGLQWMGGIIPMFGTANYAQKFQGRITITADESTSTVYMELSSLTSEDTAVYYCARFGAPAYCSGGSCYSRGYFQHWGQGTLVTVSS

SEQ ID NO: 4595 - protein, 22 aa, Artificial Sequence
  Synthetic
ARFGAPAYCSGGSCYSRGYFQH

SEQ ID NO: 4596 - protein, 105 aa, Artificial Sequence
  Synthetic
SYVLTQPPSVSVSPGQTASITCSGDELGNKYACWYQQKPGQSPVLVIYQGNRRPSGIPERFSGSNSGNTATLTISGTQAMDEADYYCQAWDSSIVFGGGTKLTVL

SEQ ID NO: 4597 - protein, 8 aa, Artificial Sequence
  Synthetic
QAWDSSIV

SEQ ID NO: 4598 - protein, 120 aa, Artificial Sequence
  Synthetic
EVQLVESGGGLVQPGGSLRLSCAASGFTFSSYVMSWVRQAPGKGLEWVSGINPSGGNTYYADSVKGRFTISRDNSKNTLYLQMNSLRGDDTAVYYCAKFLTGWYLGLDYWGQGTLVTVSS

SEQ ID NO: 4599 - protein, 13 aa, Artificial Sequence
  Synthetic
AKFLTGWYLGLDY

SEQ ID NO: 4600 - protein, 111 aa, Artificial Sequence
  Synthetic
NFMLTQPHSVSESPGKTVTISCTGSSGSIASNYVQWYQHRPGSAPTTVIYEDNQRPSGVPDRFSGSIDSSSNSASLTISGLKTEDEADYYCQSYDSGNFVVFGGGTKLTVL

SEQ ID NO: 4601 - protein, 10 aa, Artificial Sequence
  Synthetic
QSYDSGNFVV

SEQ ID NO: 4602 - protein, 120 aa, Artificial Sequence
  Synthetic
QVQLVQSGAEVKKPGDSVKVSCKASGYTFSFFGISWVRQAPGQGLEWMGWISPYNGNTNYAQNFQGRVTMTTDTSTSTAYMELRSLRSDDTAVYYCTRAAATANNWFDPWGQGTLVTVSS

SEQ ID NO: 4603 - protein, 13 aa, Artificial Sequence
  Synthetic
TRAAATANNWFDP

SEQ ID NO: 4604 - protein, 108 aa, Artificial Sequence
  Synthetic
SYVLTQPPSVSVAPGKTARITCGGNNIGSKSVHWYQQKPGQAPVLVIYYDSDRPSGIPERFSGSNSGNTATLTISRVEAGDEADYYCQVWDDGSDHWVFGGGTKLTVL

SEQ ID NO: 4605 - protein, 10 aa, Artificial Sequence
  Synthetic
VWDDGSDHWV

SEQ ID NO: 4606 - protein, 125 aa, Artificial Sequence
  Synthetic
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCASNHYDTSGPIPYWYFDLWGRGTLVTVSS

SEQ ID NO: 4607 - protein, 18 aa, Artificial Sequence
  Synthetic
ASNHYDTSGPIPYWYFDL

SEQ ID NO: 4608 - protein, 110 aa, Artificial Sequence
  Synthetic
QSVLTQPASVSGSPGQSITISCTGTSSDVGGYNYVSWYQHYPGKAPKLMIYEVTHRPSGVSNRFSGSKSGNTASLTISGLQAEDEADYYCSSSTNSSTWVFGGGTKMTVL

SEQ ID NO: 4609 - protein, 10 aa, Artificial Sequence
  Synthetic
SSSTNSSTWV

SEQ ID NO: 4610 - protein, 118 aa, Artificial Sequence
  Synthetic
QVQLQESGPGLVKPSGTLSLTCAVSGGSISSSNWWSWVRQPPGKGLEWIGEIYHGGSTNYNPSLKSRVTISVDKSKNQFSLKLSSVTAADTAVYYCASSPQAAALDYWGQGTLVTVSS

SEQ ID NO: 4611 - protein, 11 aa, Artificial Sequence
  Synthetic
ASSPQAAALDY

SEQ ID NO: 4612 - protein, 110 aa, Artificial Sequence
  Synthetic
QSVLTQPASVSGSPGQSITISCTGTSSDVGGYNYVSWYQEHPGKAPKLMIYDVSNRPSGVSNRFSGSKSGNTASLTISGLQAEDEAEYYCSSYTSSSPVVFGGGTKLTVL

SEQ ID NO: 4613 - protein, 10 aa, Artificial Sequence
  Synthetic
SSYTSSSPVV

SEQ ID NO: 4614 - protein, 124 aa, Artificial Sequence
  Synthetic
QVQLVQSGAEAKKPGSSVKVSCKASGGTFKSYIINWVRQAPGQGLEWMGEIIPIFGTANYAQKFQGRVTSTADESTSTAYMELSSLKSEDTAVYYCARGRGYSGYGASYYFDYWGQGTLVTVSS

SEQ ID NO: 4615 - protein, 17 aa, Artificial Sequence
  Synthetic
ARGRGYSGYGASYYFDY

SEQ ID NO: 4616 - protein, 111 aa, Artificial Sequence
  Synthetic
QSVLTQPPSVSGAPGQRVTISCTGSNSNIGAGYDVHWYQQLPGTAPKLLIYANSNRPSGVPDRFSGSKSGTSASLAITGLQAEDEADYYCQSYDSGLSGSVFGGGTKLTVL

SEQ ID NO: 4617 - protein, 11 aa, Artificial Sequence
  Synthetic
QSYDSGLSGSV

SEQ ID NO: 4618 - protein, 131 aa, Artificial Sequence
  Synthetic
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYFCARALYEHSDTSIYYYHYWYFDLWGRGTLVTVSS

SEQ ID NO: 4619 - protein, 22 aa, Artificial Sequence
  Synthetic
ARALYEHSDTSIYYYHYWYFDL

SEQ ID NO: 4620 - protein, 110 aa, Artificial Sequence
  Synthetic
QSALTQPPSASGSPGQSVTISCTGTSSDVGGYNYVSWYQQHPGKAPKFMMYEVSKRPSGVPDRFSGSKSGNTASLTVSGLQAEDEADYHCSSYAGNNRVIFGGGTKLTVL

SEQ ID NO: 4621 - protein, 10 aa, Artificial Sequence
  Synthetic
SSYAGNNRVI

SEQ ID NO: 4622 - protein, 122 aa, Artificial Sequence
  Synthetic
QVQLQESGPGLVKPSQTLSLTCTVSGGSISSGDYYWNWIRQPPGKGLEWIGYIYYSGVTYYNPSLKSRVTVSLDTSKNQFSLKLSSVTATDTAVYYCATAPPTVTTEQFDYWGQGTLVTVSS

SEQ ID NO: 4623 - protein, 14 aa, Artificial Sequence
  Synthetic
ATAPPTVTTEQFDY

SEQ ID NO: 4624 - protein, 108 aa, Artificial Sequence
  Synthetic
QSVLTQPPSVSAAPGQKVSISCSGSSSNIGNNYVSWYQQLPGTAPKLLIYDNNKRPSGIPDRFSGSKSGTSATLGITGLQTGDEADYYCGTWDSSLSAGVFGGGTKLT

SEQ ID NO: 4625 - protein, 11 aa, Artificial Sequence
  Synthetic
GTWDSSLSAGV

SEQ ID NO: 4626 - protein, 123 aa, Artificial Sequence
  Synthetic
QVQLVQSGAEVKKPGSSVKVSCKSSGGTFSSYAITWVRQAPGQGLEWMGGIIPIFGKPNYAQKFQGRVTITADKSTSTAYMELSSLRSEDTAVYYCARAEPLNYGDYGLADFWGQGTLVTVSS

SEQ ID NO: 4627 - protein, 16 aa, Artificial Sequence
  Synthetic
ARAEPLNYGDYGLADF

SEQ ID NO: 4628 - protein, 110 aa, Artificial Sequence
  Synthetic
QSVLTQPPSASGTPGQRVTISCSGSSSNIGSNYVYWYQQLPGTAPKLLIYRNNQRPSGVLNRFSGSKSGTSASLAISGLRSEDEADYYCATWDDSLSAWVFGGGTKLTVL

SEQ ID NO: 4629 - protein, 11 aa, Artificial Sequence
  Synthetic
ATWDDSLSAWV

SEQ ID NO: 4630 - protein, 132 aa, Artificial Sequence
  Synthetic
EVQLLESGGGLVQPGGSLRLSCAASGFTFSSYAMSWVRQAPGKGLEWVSGISGSGGNPYYADSVKGRFTISRDNSKNTLYLLMNRLRVEDTAVYYCAKDGSPRYCSGGSCVAQPDYNWFDPWGQGTLVTVSS

SEQ ID NO: 4631 - protein, 25 aa, Artificial Sequence
  Synthetic
AKDGSPRYCSGGSCVAQPDYNWFDP

SEQ ID NO: 4632 - protein, 105 aa, Artificial Sequence
  Synthetic
SYVLTQPPSVSVAPGRTARITCGGNNIGSKSVHWYQQKPGQAPVLVIYYDTDRPSGIPERFSGSNSGNTAILTISRVEAGDEADYYCQVWDKYVVFGGGTKLTVL

SEQ ID NO: 4633 - protein, 8 aa, Artificial Sequence
  Synthetic
QVWDKYVV

SEQ ID NO: 4634 - protein, 119 aa, Artificial Sequence
  Synthetic
EVQLVESGGGLIQPGGSLRLSCAASGVTVTSNYMTWVRQAPGKGLEWVSIIYSGGSTFYADSVKGRFTISRHNSKNTLYLQMNSLRPEDTAVYYCARVLPIRWLYFDYWGQGTLVTVSS

SEQ ID NO: 4635 - protein, 13 aa, Artificial Sequence
  Synthetic
ARVLPIRWLYFDY

SEQ ID NO: 4636 - protein, 110 aa, Artificial Sequence
  Synthetic
QSTQPPSVSEAPGQRVTISCTGSSSNIGAGYDVHWYQQLPGTAPKLLIYGNNNRPSGVPDRFSGSKSGTSASLAIAGLQAEDEADYYCQSYDSSLSGYVVFGGGTKLTVL

SEQ ID NO: 4637 - protein, 12 aa, Artificial Sequence
  Synthetic
QSYDSSLSGYVV

SEQ ID NO: 4638 - protein, 130 aa, Artificial Sequence
  Synthetic
QVQLQQSGPGLVKPSQTLSLTCAISGDSVPTNSAAWNWIRQSPSRGLEWLGRTYYRSKWYNDYAVSVKSRITINPDTSKNQFSLQLNSVTPDDTAVYYCARVIAAAAVDDYFYYYGMDVWGQGTAVSVSS

SEQ ID NO: 4639 - protein, 20 aa, Artificial Sequence
  Synthetic
ARVIAAAAVDDYFYYYGMDV

SEQ ID NO: 4640 - protein, 109 aa, Artificial Sequence
  Synthetic
SYVLTQPPSVSVSPGQTARITCSGDALSKHYAYWYQQRPGQAPVLVISKDSERPSGIPERFSGSSSGTTVTLTISGVQAEDEADYYCQSADSTGTFQVVFGGGTKLTVL

SEQ ID NO: 4641 - protein, 12 aa, Artificial Sequence
  Synthetic
QSADSTGTFQVV

SEQ ID NO: 4642 - protein, 126 aa, Artificial Sequence
  Synthetic
EVQLLESGGGLVQPGGSLRLSCAASGFTFSSYAMTWVRQAPGKGLEWVSSISGNGNSTYYADSVKGRFTISRDNSKNTLYLQMNSLRAEDTAVYYCAKYLFPITVVRNYYYGMDVWGQGTTVTVSS

SEQ ID NO: 4643 - protein, 19 aa, Artificial Sequence
  Synthetic
AKYLFPITVVRNYYYGMDV

SEQ ID NO: 4644 - protein, 109 aa, Artificial Sequence
  Synthetic
SYELTQPPSVSVSPGQTARIACSGDPLPNQYAYWYQQRPGQAPVLVIYKDSERPSGIPERFSGSSSGTTVTLTISRVQAEDEADYYCQSADSSGTYPEVFGGGTKLTVL

SEQ ID NO: 4645 - protein, 12 aa, Artificial Sequence
  Synthetic
QSADSSGTYPEV

SEQ ID NO: 4646 - protein, 116 aa, Artificial Sequence
  Synthetic
EVQLVESGGDLVQPGGSLRLSCAASGFTFSSYWMHWVRQAPGKGLVWVSRINSDGSITRYADSVKGRFTISRDNAKKTVYLQMNSLRAEDTAVYYCARDLLGTGYWGGQGTLVTVS

SEQ ID NO: 4647 - protein, 10 aa, Artificial Sequence
  Synthetic
ARDLLGTGYW

SEQ ID NO: 4648 - protein, 109 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDTFWVFGTGTKVTVL

SEQ ID NO: 4649 - protein, 12 aa, Artificial Sequence
  Synthetic
QVWDSSSDTFWV

SEQ ID NO: 4650 - protein, 121 aa, Artificial Sequence
  Synthetic
EVQLVESGGGLIQPGGSLRLSCATSGFTVSANYMSWVRQAPGTGLEWVSVIYSGVSTYYADSVKGRFTISRDNSKNTLYLQMNSLRVEDTAVYYCARLSGHKGYDGGFDIWGQGTMVTVSS

SEQ ID NO: 4651 - protein, 15 aa, Artificial Sequence
  Synthetic
ARLSGHKGYDGGFDI

SEQ ID NO: 4652 - protein, 112 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDAADYYCQSYDNSLSGPWVFGGGTKLTVL

SEQ ID NO: 4653 - protein, 12 aa, Artificial Sequence
  Synthetic
QSYDNSLSGPWV

SEQ ID NO: 4654 - protein, 126 aa, Artificial Sequence
  Synthetic
QVQLVQSGAEVKKPGSSVKVSCKASGGTFSSYAISWVRQAPGQGLEWMGGIIPMFATAKHAQKFQGRVTITADEPTRTAYMELSSLRSDDTAVYYCARAEWELLIGQMYYYYMDVWGKGTTVTVSS

SEQ ID NO: 4655 - protein, 19 aa, Artificial Sequence
  Synthetic
ARAEWELLIGQMYYYYMDV

SEQ ID NO: 4656 - protein, 108 aa, Artificial Sequence
  Synthetic
QSALTQPASVSGSPGQSITISCTGISSDVGGYNYVSWYQQHPGKAPKLMIYDLDNRPSGVSNRFSGSRSGNTASLTISGLQAEDEADYYCSSYATSRVFGGGTKLTVL

SEQ ID NO: 4657 - protein, 8 aa, Artificial Sequence
  Synthetic
SSYATSRV

SEQ ID NO: 4658 - protein, 129 aa, Artificial Sequence
  Synthetic
QVQLVQSGAEVRKSGSSVKVSCKASGGTFSSYGISWVRQAPGQGLEWMGGITPIFGTLNYAQKFQGRVTITADKSTSTAYMELSSLRSEDTAVYYCARDRTGGYCSGGSCYDFHWFDPWGQGTLVTVSS

SEQ ID NO: 4659 - protein, 22 aa, Artificial Sequence
  Synthetic
ARDRTGGYCSGGSCYDFHWFDP

SEQ ID NO: 4660 - protein, 110 aa, Artificial Sequence
  Synthetic
QSVLTQPPSASGTPGQRVTISCSGSSSNIGSNTVNWYQQLPGTAPKLLIYNNNQRPSGVPDRFSGSKSGTAASLAISGLQSEDEADYYCAAWDDSLNGHVFGGGTKVTVL

SEQ ID NO: 4661 - protein, 11 aa, Artificial Sequence
  Synthetic
AAWDDSLNGHV

SEQ ID NO: 4662 - protein, 125 aa, Artificial Sequence
  Synthetic
EVQLVQSGAEVKKPGESLKISCKGSGYSFTSYWIGWVRQMPGKGLEWMGIIYPGDSDTRYSPSFQGHVTISADKSITTAYLQWSSLKASDTAVYYCARIVPAARLPTYFYGMDVWGQGTTVTLSS

SEQ ID NO: 4663 - protein, 18 aa, Artificial Sequence
  Synthetic
ARIVPAARLPTYFYGMDV

SEQ ID NO: 4664 - protein, 116 aa, Artificial Sequence
  Synthetic
QVLTQPRSASASLGASVTLTCTLSSGYSNYKVDWYHQRPGKGPRFVMRVGIGGIVGSKGDGIPDRFSVLGSGLNRYLTIKNIQEEDESDYHCGADHGSGSNFALWVFGGGTKLTVL

SEQ ID NO: 4665 - protein, 14 aa, Artificial Sequence
  Synthetic
GADHGSGSNFALWV

SEQ ID NO: 4666 - protein, 119 aa, Artificial Sequence
  Synthetic
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREAYYYGPIDYWGQGTLVTVSS

SEQ ID NO: 4667 - protein, 12 aa, Artificial Sequence
  Synthetic
AREAYYYGPIDY

SEQ ID NO: 4668 - protein, 112 aa, Artificial Sequence
  Synthetic
QSVLTQPPSVSGAPGQRVTISCTGSSSNIGAGYDIHWYQQLPGTAPKLLIYGNSIRPSGVPDRFSGSKSGTSASLAITGLQAEDEADYYCQSYDSSLSGPVVFGGGTKLTVL

SEQ ID NO: 4669 - protein, 12 aa, Artificial Sequence
  Synthetic
QSYDSSLSGPVV

SEQ ID NO: 4670 - protein, 122 aa, Artificial Sequence
  Synthetic
QVQLVESGGGLVKPGGSLRLSCAASGFTFSVYYMSWIRQAPGKGLEWVSYISSTGSTIYYADSVKGRFTISRDNAKNSVYLQMNSLRAEDTAVYYCARAEYSSVASTPFDYWGQGALVTVSS

SEQ ID NO: 4671 - protein, 15 aa, Artificial Sequence
  Synthetic
ARAEYSSVASTPFDY

SEQ ID NO: 4672 - protein, 109 aa, Artificial Sequence
  Synthetic
QSVLTQPPSASGTPGQRVTISCSGSSSNIGSNYVFWYQQLPGTAPKLLIYRNNQRPSGVPDRFSGSKSGTSASLAISGLRSEDEADYYCAAWDDSLSGVFGGGTKLTVL

SEQ ID NO: 4673 - protein, 10 aa, Artificial Sequence
  Synthetic
AAWDDSLSGV

SEQ ID NO: 4674 - protein, 117 aa, Artificial Sequence
  Synthetic
EVQLVETGGGLIQPGGSLRLSCAASGITVSSNYMSWVRQAPGKGLEWVSVIYSGGSTFYADSVKGRFTISRDKSKNTLYLQMNSLRVEDTAVYYCARDFWEGAMDVWGQGTTVTVSS

SEQ ID NO: 4675 - protein, 11 aa, Artificial Sequence
  Synthetic
ARDFWEGAMDV

SEQ ID NO: 4676 - protein, 108 aa, Artificial Sequence
  Synthetic
SYVLTQPPSVSVAPGQTARITCGGNNIGSKNVHWYQQKPGQAPVLVVYDDSDRPSGIPERFSGSNSGNTATLTISRVEAGDEADYYCQVWDSSGHPYVFGTGTKVTVL

SEQ ID NO: 4677 - protein, 11 aa, Artificial Sequence
  Synthetic
QVWDSSGHPYV

SEQ ID NO: 4678 - protein, 121 aa, Artificial Sequence
  Synthetic
QVQLQESGPGLVKPSETLSLTCTVSGGSISSYYWSWIRQPAGKGLEWIGRIYTSGNTNYNPSLKSRVTMSVDTSKNQFSLKLTSVTAADTAVYYCARDPYSGSYFSGLDYWGQGTLVTVSS

SEQ ID NO: 4679 - protein, 15 aa, Artificial Sequence
  Synthetic
ARDPYSGSYFSGLDY

SEQ ID NO: 4680 - protein, 109 aa, Artificial Sequence; identical to SEQ ID NO: 4672
  Synthetic

SEQ ID NO: 4681 - protein, 10 aa, Artificial Sequence
  Synthetic
AAWDDSLSGV

SEQ ID NO: 4682 - protein, 129 aa, Artificial Sequence
  Synthetic
QVQLVQSGAEVKKPGASVKVSCKASGYTFTNYGINWVRQAPGQGLEWMGWISIYSGNTNYAQKLQGRVTMTTDTSTSTAYMELRSLRSDDTAVYYCARRVFRAEYDVLTGFYSSDFDYWGQGTLVTVSS

SEQ ID NO: 4683 - protein, 22 aa, Artificial Sequence
  Synthetic
ARRVFRAEYDVLTGFYSSDFDY

SEQ ID NO: 4684 - protein, 110 aa, Artificial Sequence
  Synthetic
QSVLTQPPSASGTPGQRVTISCSGSSSNIGSYPVNWYQQLPGTAPKLVIYSKNQRPSGAPDRFSGSKSGTSASLAISGLQSEDEADYYCAAWDDSLDGVVFGGGTKLTVL

SEQ ID NO: 4685 - protein, 11 aa, Artificial Sequence
  Synthetic
AAWDDSLDGVV

SEQ ID NO: 4686 - protein, 119 aa, Artificial Sequence
  Synthetic
QVQLQESGPGLVKPSQTLSLTCTVSGGSISSGGYYWSWIRQHPGKGLEWIGYIYYSGSTYYNPSLKSLVTISVDTSKNQFSLKLSSVTAADTAVYYCAREDDSSWYTPWGQGTLVTVSS

SEQ ID NO: 4687 - protein, 11 aa, Artificial Sequence
  Synthetic
AREDDSSWYTP

SEQ ID NO: 4688 - protein, 108 aa, Artificial Sequence
  Synthetic
EIVLTQSPATLSLSPGERATLSCRASQSVSSYLAWYQQKPGQAPRLLIYDTSNRATGIPARFSGSGSGTDFTLTISSLEPEDFAVYYCQQRYNWPPLTFGGGTKVEIK

SEQ ID NO: 4689 - protein, 10 aa, Artificial Sequence
  Synthetic
QQRYNWPPLT

SEQ ID NO: 4690 - protein, 122 aa, Artificial Sequence
  Synthetic
QVQLQESGPGLVKPSETLSLTCTVSGGSISSYYWSWIRQPPGKGLEWIGYIYYSGSTNYNPSLKSRVTMSVDTSKNKFSLKLSSVTAADTAVYYCASDYYDTSGYCYGMDVWGQGTTVTVSS

SEQ ID NO: 4691 - protein, 16 aa, Artificial Sequence
  Synthetic
ASDYYDTSGYCYGMDV

SEQ ID NO: 4692 - protein, 106 aa, Artificial Sequence
  Synthetic
DIQMTQSPSSVSASVGDRVTITCRASQGINSWLAWYQQKPGKAPKLLIYATTNLQSGVPSRFSGSGSGTDFTLTISSLQPEDFATYYCQQANSFPLTFGGGTKVEI

SEQ ID NO: 4693 - protein, 9 aa, Artificial Sequence
  Synthetic
QQANSFPLT

SEQ ID NO: 4694 - protein, 122 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKNLYRYGYLAYPDYWGQGTLVTVSS

SEQ ID NO: 4695 - protein, 15 aa, Artificial Sequence
  Synthetic
AKNLYRYGYLAYPDY

SEQ ID NO: 4696 - protein, 105 aa, Artificial Sequence
  Synthetic
DIQMTQSPLSASVGDRVTITCQASQDISNYLNWYQQKPGKAPKLLIYDASNLETGVPSRFSGSGSGTDFTFTISSLQPEDIATFYCQQYDNLPPTFGGGTKVEIK

SEQ ID NO: 4697 - protein, 9 aa, Artificial Sequence
  Synthetic
QQYDNLPPT

SEQ ID NO: 4698 - protein, 125 aa, Artificial Sequence
  Synthetic
QVQLVQSGAEVKKPGASVKVSCKASGYTFTNYYMHWVRQAPGQGLEWMGIINPSGGSTSYAQKFQGRVTMTRDTSTSTVYMELSSLTSEDTAVYYCARPGVPVPAYVNSWYFDYWGQGTLVTVSS

SEQ ID NO: 4699 - protein, 18 aa, Artificial Sequence
  Synthetic
ARPGVPVPAYVNSWYFDY

SEQ ID NO: 4700 - protein, 105 aa, Artificial Sequence
  Synthetic
DIQLTQSPLSASVGDRVTITCRASQGISSYLAWYQQKPGKAPNLLIYAASTLQSGVPSRFSGSGSGTEFTLTISSLQPEDFATYYCQQLNTYPPTFGQGTKVEIK

SEQ ID NO: 4701 - protein, 9 aa, Artificial Sequence
  Synthetic
QQLNTYPPT

SEQ ID NO: 4702 - protein, 130 aa, Artificial Sequence
  Synthetic
EVQLLESGGGLVQPGGSLRLSCAASGFTFSSYAMTWVRQAPGKGLEWVSTISGSGGSTLYADSVKGRFTISRDNSKNTLYLQMNSLRAEDTAVYYCAKDALYCSGGSCYGGLSSYYFDYWGQGTLVTVSS

SEQ ID NO: 4703 - protein, 23 aa, Artificial Sequence
  Synthetic
AKDALYCSGGSCYGGLSSYYFDY

SEQ ID NO: 4704 - protein, 104 aa, Artificial Sequence
  Synthetic
DIQMTQSPLSASVGDRVTITCRASQNINSWLAWYQQKPGKAPKVLIYKASSLEDEVPSRFSGSGSGTEFTLTISSLQPDDFATYYCQQYNSYSTFGQGTKLEIK

SEQ ID NO: 4705 - protein, 8 aa, Artificial Sequence
  Synthetic
QQYNSYST

SEQ ID NO: 4706 - protein, 122 aa, Artificial Sequence
  Synthetic
EVQLVESGGGLIQPGGSLRLSCAASGFTVSSNYMSWVRQAPGKGLQWVSYIYSSGSTYYADSVKGRFTISRDDSKNTLYLQMNSLRAEDTAVYYCASLYSSGWYLRGAPQVWGQGTMVTVSS

SEQ ID NO: 4707 - protein, 16 aa, Artificial Sequence
  Synthetic
ASLYSSGWYLRGAPQV

SEQ ID NO: 4708 - protein, 110 aa, Artificial Sequence
  Synthetic
EIVMTQSPATLSVSPGERATLSCRASQSVSSYLAWYQQKPGQAPRLLIYGASTRATGIPARFSGSGSGTEFTLTISSLQSEDFAVYYCQQYNNWPPRSYTFGQGTKLEIK

SEQ ID NO: 4709 - protein, 12 aa, Artificial Sequence
  Synthetic
QQYNNWPPRSYT

SEQ ID NO: 4710 - protein, 122 aa, Artificial Sequence
  Synthetic
EVQLVESGGGLVQPGGSLRLSCAASGLTVSSNYMSWVRQAPGKGLEWVSVIFSGGSTYYADSVKGRFTISRDNSKNTLYLQMNSLRAGDTAVYYCARGAAAGTFYYYGMDVWGQGTTVIVSS

SEQ ID NO: 4711 - protein, 16 aa, Artificial Sequence
  Synthetic
ARGAAAGTFYYYGMDV

SEQ ID NO: 4712 - protein, 105 aa, Artificial Sequence
  Synthetic
EIVMTQSPLSVSPGVRATLSCRASQSVNSNLAWYQQKPGLAPSLLIYGASTRATGIPARFSGSGFGTEFTLTISSLQFEDFAVYYCQQYNTWPVTFGGGTKVEIK

SEQ ID NO: 4713 - protein, 9 aa, Artificial Sequence
  Synthetic
QQYNTWPVT

SEQ ID NO: 4714 - protein, 124 aa, Artificial Sequence
  Synthetic
EVQLVESGGGLVKPGGSLRLSCAASGFTFSSYTMNWVRQAPGKGLEWVSSISSSSNYIYYADSVKGRFTISRDNAKNSLYLQMNSLRAEDTAVYYCAREHRRYYESSGYPNDYWGQGTLVTVSS

SEQ ID NO: 4715 - protein, 17 aa, Artificial Sequence
  Synthetic
AREHRRYYESSGYPNDY

SEQ ID NO: 4716 - protein, 106 aa, Artificial Sequence
  Synthetic
DIQLTQSPSFLSASVGDRVTITCRASQGISSYLAWFQQKPGKAPKLLIYAASTLQSGVPSRFSGSGSGTEFTLTISSLQSEDFATYYCQELDSYRTFGPGTKVDIK

SEQ ID NO: 4717 - protein, 8 aa, Artificial Sequence
  Synthetic
QELDSYRT

SEQ ID NO: 4718 - protein, 127 aa, Artificial Sequence
  Synthetic
EVQLLESGGALIQPGGSLRLSCAASGFSFSSYAMTWVRQAPGKGLEWVSVISATGGSTYYADSVKGRFTISRDNSKNTLYLQMNSLRVEDTAVYYCAKDGMEWVLVDYYDYYGMDVWGRGTTVTVSS

SEQ ID NO: 4719 - protein, 20 aa, Artificial Sequence
  Synthetic
AKDGMEWVLVDYYDYYGMDV

SEQ ID NO: 4720 - protein, 112 aa, Artificial Sequence
  Synthetic
DIVMTQTPLSSPVTLGQPASISCRSSQSLVHSDGYTYLSWLQQRPGQPPRLLIYKVSNRFSGVPDRFSGSGAGTDFTLKISRVEAEDVGVYYCMQATQFPPTFGQGTKVEIK

SEQ ID NO: 4721 - protein, 9 aa, Artificial Sequence
  Synthetic
MQATQFPPT

SEQ ID NO: 4722 - protein, 125 aa, Artificial Sequence
  Synthetic
QVQLVQSGAAVKKPGASVKVSCKASGYTFTTYGISWVRQAPGQGLEWMGWISAYNGNTKYGQKFQGRVTMTTDTSTSTAYMELRSLRSDDTAVFYCARDNGWFGELSGYQTFDYWGQGTLVTVSS

SEQ ID NO: 4723 - protein, 18 aa, Artificial Sequence
  Synthetic
ARDNGWFGELSGYQTFDY

SEQ ID NO: 4724 - protein, 106 aa, Artificial Sequence
  Synthetic
EIVLTQSPATLSLSPGERATLSCRASQSISRFLTWFQQKPGQAPRLLIYDASNRATGIPARFSGSGSGTDFTLTISSLEPEDFAVYYCHQRTKGLTFGGGTKVEIK

SEQ ID NO: 4725 - protein, 8 aa, Artificial Sequence
  Synthetic
HQRTKGLT

SEQ ID NO: 4726 - protein, 117 aa, Artificial Sequence
  Synthetic
EVQLVETGGGLIQPGGSLRLSCAASGFTVSRNYMSWVRQAPGKGLEWVSVIYSGGSTFYADSVKGRFTISRDNSKNTLYLQMNSLRVEDTAVYYCARSVVDDAFDIWGQGTMVTVSS

SEQ ID NO: 4727 - protein, 11 aa, Artificial Sequence
  Synthetic
ARSVVDDAFDI

SEQ ID NO: 4728 - protein, 107 aa, Artificial Sequence
  Synthetic
DIQLTQSPVLSASVGDRVTITCRASQGISSYLAWYQQNPGKAPKLLIYAASTLQSGVPSRFSGSGSGTEFTLTISSLQPEDFATYYCQQLNSYPPGTFGQGTRLEIK

SEQ ID NO: 4729 - protein, 10 aa, Artificial Sequence
  Synthetic
QQLNSYPPGT

SEQ ID NO: 4730 - protein, 126 aa, Artificial Sequence
  Synthetic
EVQLVETGGGLIQPGGSLRLSCAASGFSVSNNYMSWVRQAPGKGLEWLSIVYSGGTTYYADSVKGRFTISRDKAKNTLNLQLNRLRAEDTAVYYCARAKAAPEGHYYFYYYGLDVWGHGTAVTVSS

SEQ ID NO: 4731 - protein, 20 aa, Artificial Sequence
  Synthetic
ARAKAAPEGHYYFYYYGLDV

SEQ ID NO: 4732 - protein, 107 aa, Artificial Sequence
  Synthetic
DIQMTQSPSTLSASVGDRVTITCRASESISSYLAWYQQTPGKAPKLLMYKTSILESGVPSRFSGSGSGTEFTLTISGLQPDDFATYYCQHYNTYSYTFGQGTKLEIK

SEQ ID NO: 4733 - protein, 9 aa, Artificial Sequence
  Synthetic
QHYNTYSYT

SEQ ID NO: 4734 - protein, 123 aa, Artificial Sequence
  Synthetic
EVQLLESGGGLVQPGGSLRLSCAASGFTFSNYGMSWVRQAPGKGLEWLSDVSGSGGSTYYADSVKGRFTISRDNSKNTLYLQMNSLRGEDTAVYYCAKHGSFFIAAVEPFDYWGQGTLVTVSS

SEQ ID NO: 4735 - protein, 16 aa, Artificial Sequence
  Synthetic
AKHGSFFIAAVEPFDY

SEQ ID NO: 4736 - protein, 107 aa, Artificial Sequence
  Synthetic
DIQMTQSPSSLSASVGDRVTITCRASQTINSYLNWYQQKPGKAPKLLIYAASSLQSGVPSRFSGSGSGTDFTLTISSLQPEDFATYYCQQTYITPVLFGPGTKVDIK

SEQ ID NO: 4737 - protein, 9 aa, Artificial Sequence
  Synthetic
QQTYITPVL

SEQ ID NO: 4738 - protein, 129 aa, Artificial Sequence
  Synthetic
QVQLVESGGGVVQPGRSLRLSCAASGFTFSNYVMHWVRQAPGKGLEWVAVISSDGSSKYYADSVKGRFTISRDNSKSTLFLQMNTLRAEDTAVYYCARDGGIMITFGGVIAPVDAFDIWGQGTMVTVSS

SEQ ID NO: 4739 - protein, 22 aa, Artificial Sequence
  Synthetic
ARDGGIMITFGGVIAPVDAFDI

SEQ ID NO: 4740 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYTTLMYTFGQGTKLEIK

SEQ ID NO: 4741 - protein, 10 aa, Artificial Sequence
  Synthetic
QQSYTTLMYT

SEQ ID NO: 4742 - protein, 123 aa, Artificial Sequence
  Synthetic
QVQLVESGGGVVQPGRSLRLSCAASGFTFSTYGMHWVRQAPGKGLEWVALIFYDGSKKYYADSVKGRFTISRDNSRNTLYLQINSLRAEDTAVYYCAKGGWFGELFQGAFDYWGQGTLVTVSS

SEQ ID NO: 4743 - protein, 16 aa, Artificial Sequence
  Synthetic
AKGGWFGELFQGAFDY

SEQ ID NO: 4744 - protein, 105 aa, Artificial Sequence
  Synthetic
DIQMTQSPLSASVGDRVTITCQASQDISNYLNWYQQKPGKAPKVLIYDASNLETGVPSRFSASGSGTDFTFTISSLQPEDIATYYCQQYDNLPITFGQGTRLEIK

SEQ ID NO: 4745 - protein, 9 aa, Artificial Sequence
  Synthetic
QQYDNLPIT

SEQ ID NO: 4746 - protein, 125 aa, Artificial Sequence
  Synthetic
QVQLQESGPGLVKPSQTLSLTCTVSGGSISSGGYYWSWIRQHPGKGLEWIGHIYYSGSTYYNPSLKSRVAISGDTSKNQFSLKLSSVTAADTAVYHCARSGLLPAEYSYYYMDVWGKGTTVTVSS

SEQ ID NO: 4747 - protein, 17 aa, Artificial Sequence
  Synthetic
ARSGLLPAEYSYYYMDV

SEQ ID NO: 4748 - protein, 106 aa, Artificial Sequence
  Synthetic
DIQMTQSPSTLSASVGDRVTITCRASQSISKWLAWYQQKPGKAPKLLIYKASSLESGVPSRFSGSGSGTEFTLTISSLQPDDFATYYCQQYNRYWTFGQGTKVEIK

SEQ ID NO: 4749 - protein, 8 aa, Artificial Sequence
  Synthetic
QQYNRYWT

SEQ ID NO: 4750 - protein, 122 aa, Artificial Sequence
  Synthetic
QVQLVESGGGVVQPGRSLRLSCAASGFTFSTYAMHWVRQSPGKGLVWVALVSYDGSNKSYSDSVKGRFTISRDNSKNTLFLQMNSLRAEDTALYYCAKNIYSYGSTSYFDYWGQGTLVTVSS

SEQ ID NO: 4751 - protein, 15 aa, Artificial Sequence
  Synthetic
AKNIYSYGSTSYFDY

SEQ ID NO: 4752 - protein, 107 aa, Artificial Sequence
  Synthetic
DIQMTQSPSSLSASVRDRVTITCQASQDISNYLNWYQQKPGKAPKLLIYDASNLEAGVPSRFSGSGSGTDFKFTISSLQPEDIATYYCLQYDNFPLTFGGGTKVEIK

SEQ ID NO: 4753 - protein, 9 aa, Artificial Sequence
  Synthetic
LQYDNFPLT

SEQ ID NO: 4754 - protein, 128 aa, Artificial Sequence
  Synthetic
QVQLVQSGAEVKKPGASVKVSCKASGYTFTNYGFSWVRQAPGQGLEWMGWISAYNGNTDYAQMLQGRVTMTTDTSTSTAYMELRSLTSDDTAVYYCARDSSTWYPQTYNSYYYGMDVWGQGTTVTVSS

SEQ ID NO: 4755 - protein, 21 aa, Artificial Sequence
  Synthetic
ARDSSTWYPQTYNSYYYGMDV

SEQ ID NO: 4756 - protein, 111 aa, Artificial Sequence
  Synthetic
DVVMTQSPSLPVTLGQPASISCRSSQSLVYSDGDTYLNWFQQRPGQSPRRLIYKVSNRDSGVPDRFSGSGSGTDFILKISRVEAEDVGVYYCMQGTHWPRTFGQGTKVEIK

SEQ ID NO: 4757 - protein, 9 aa, Artificial Sequence
  Synthetic
MQGTHWPRT

SEQ ID NO: 4758 - protein, 135 aa, Artificial Sequence
  Synthetic
EVQLVESGGGLVKPGGSLRLSCAAAGFTFSNAWMNWVRQAPGKGLEWVGRIKSNTDGGTIAYAAPVKGRFTISRDDSKNTLYLRMNSLKTEDTAVYYCTTDRYPQLLWVGDPTPYYYYYYYMDVWGKGTTVTVSS

SEQ ID NO: 4759 - protein, 26 aa, Artificial Sequence
  Synthetic
TTDRYPQLLWVGDPTPYYYYYYYMDV

SEQ ID NO: 4760 - protein, 106 aa, Artificial Sequence
  Synthetic
EIVLTQSPATLSLSPGERATLSCRASQSVSSYLAWYQQKPGQAPRLLIYEASNRATGIPARFSGSGSGTDFTLTISSLEPEDFAVYYCQQRSNFLTFGGGTKVEIK

SEQ ID NO: 4761 - protein, 8 aa, Artificial Sequence
  Synthetic
QQRSNFLT

SEQ ID NO: 4762 - protein, 120 aa, Artificial Sequence
  Synthetic
QVQLVQSGAEVKKPGSSVKVSCKASGGTFSSYAISWVRQAPGQGLEWMGGIIPLFGTANYAEKFQGRVTITADESTTTAYMELSSLRSEDTAVYYCATFDSIFDYYIDVWGKGTTVTVSS

SEQ ID NO: 4763 - protein, 13 aa, Artificial Sequence
  Synthetic
ATFDSIFDYYIDV

SEQ ID NO: 4764 - protein, 107 aa, Artificial Sequence
  Synthetic
EIVLTQSPGTLSLSPGERATLSCRASQSVSSSYLAWYQQKAGQAPRLLIYGASSRATGIPDRFSGSGSGTDFTLTISRLEPEDFAVYYCQQYGTSRTFGQGTKVEIK

SEQ ID NO: 4765 - protein, 8 aa, Artificial Sequence
  Synthetic
QQYGTSRT

SEQ ID NO: 4766 - protein, 120 aa, Artificial Sequence
  Synthetic
EVQLVESGGGLVKPGGSLRLSCAASGFTFSTYSMNWVRQAPGKGLECVASISRSSSYIYYADSVKGRFTISRDNAKNSLYLQMNTLRAEDTAVYYCAREWAGVDWVLDYWGQGTLVTVSS

SEQ ID NO: 4767 - protein, 13 aa, Artificial Sequence
  Synthetic
AREWAGVDWVLDY

SEQ ID NO: 4768 - protein, 108 aa, Artificial Sequence
  Synthetic
DIQMTQSPSSLSASVGDRVTITCRASQSIRNFLNWYQQKPGKAPKLLIYAASSLQSGVPSRFSGSGSGTHFTLTISSLQPEDFATYYCQQSYSTPPITFGQGTRLEIK

SEQ ID NO: 4769 - protein, 10 aa, Artificial Sequence
  Synthetic
QQSYSTPPIT

SEQ ID NO: 4770 - protein, 123 aa, Artificial Sequence
  Synthetic
QVQLVESGGGLVKPGGSLRLSCVASGFSLTDYYYMSWIRQAPGKGLEWVSYISTGSVTIYYADSVKGRFTISRDNAKNSVFLQMNSLRAEDTAVYYCVRDLLYTSPPGGMDVWGQGTTVTVSS

SEQ ID NO: 4771 - protein, 15 aa, Artificial Sequence
  Synthetic
VRDLLYTSPPGGMDV

SEQ ID NO: 4772 - protein, 107 aa, Artificial Sequence
  Synthetic
DIQMTQSPSSLSASVGDRVTITCRASQTIENFLNWYQQKPGKAPKLLIYAASTLQSGVPSRFSGSGSGTEFTLTITSLQVEDLATYHCQQSYRPPYTFGQGTKLEIK

SEQ ID NO: 4773 - protein, 9 aa, Artificial Sequence
  Synthetic
QQSYRPPYT

SEQ ID NO: 4774 - protein, 121 aa, Artificial Sequence
  Synthetic
EVQLVESGGGLIQPGGSLRLSCAASGLTVSSNYMSWVRQAPGKGLEWVSVIYSGGSTFYADSVKGRFTISRDNSKNTLYLQMNSLRAEDTAVYYCARGDGGSYPGGAFDIWGQGTMVTVSS

SEQ ID NO: 4775 - protein, 15 aa, Artificial Sequence
  Synthetic
ARGDGGSYPGGAFDI

SEQ ID NO: 4776 - protein, 108 aa, Artificial Sequence
  Synthetic
DIQMTQSPSSLSASVGDRVTVTCRASQSISTYLNWYQQKPGRAPKLLIYAASTLQSGVPSRFSGSGSGTDFTLTISSLQPEDFATYYCQQSYSLPPVSFGGGTKVEIK

SEQ ID NO: 4777 - protein, 10 aa, Artificial Sequence
  Synthetic
QQSYSLPPVS

SEQ ID NO: 4778 - protein, 127 aa, Artificial Sequence
  Synthetic
QVQLVQSGAEVKKPGASVKVSCKASGYTFTNYYIHWVRQAPGQGLEWMGIINPSGGSTTYAQKFQGRVTMTRGPATSTVYMELSSLISEDTAVYYCARDARVYSDYDFHYFYYMDVWGKGTTVTVSS

SEQ ID NO: 4779 - protein, 20 aa, Artificial Sequence
  Synthetic
ARDARVYSDYDFHYFYYMDV

SEQ ID NO: 4780 - protein, 106 aa, Artificial Sequence
  Synthetic
DIQMTQSPVLSASVGDRVTITCRASQSISNWLAWYQQKPGKAPKLLIYKASSLESGVPSRFSGSGSGTEFTLTISSLQPDDFATYYCQQYNSYSVTFGQGTKVELK

SEQ ID NO: 4781 - protein, 9 aa, Artificial Sequence
  Synthetic
QQYNSYSVT

SEQ ID NO: 4782 - protein, 119 aa, Artificial Sequence
  Synthetic
QVQLQESGPGLVKPSQTLSLTCTVSGGSITSYGYYWSWIRQYPGKGLEWIGHIYYSGSTYYNPSLKSRITISVDTSKNQFSLKLSSVTAADTAVYYCAREGTWGGIDYWGQGTLVTVSS

SEQ ID NO: 4783 - protein, 11 aa, Artificial Sequence
  Synthetic
AREGTWGGIDY

SEQ ID NO: 4784 - protein, 107 aa, Artificial Sequence
  Synthetic
DIQMTQSPSLSASVGDRVTITCQASQDINNFLNWYQQKPGKAPKLLIYDASNLETGVPSRFSGSGSGTYFTFTISSLQPEDIATYYCQQYNIVPPRTFGQGTKLEIK

SEQ ID NO: 4785 - protein, 10 aa, Artificial Sequence
  Synthetic
QQYNIVPPRT

SEQ ID NO: 4786 - protein, 120 aa, Artificial Sequence
  Synthetic
QVQLVESGGGVVQPGRSLRLSCAASGFTFSTYGMHWVRQAPGKGLEWVAVIWYDGSNTYYTDSVKGRFTISRDNSKNTLYLHMNSLRAEDTAVYYCARVRGYTSGWVDYWGQGTLVTVSS

SEQ ID NO: 4787 - protein, 13 aa, Artificial Sequence
  Synthetic
ARVRGYTSGWVDY

SEQ ID NO: 4788 - protein, 106 aa, Artificial Sequence
  Synthetic
DIQLTQSPSLSASVGDRVTITCRASQGISSYLAWYQQKPGKAPKLLIYAASTLQSGVPSRFSGSGSGTEFTLTVSSLQPEDFATYYCQHLNSSLLTFGGGTKVEIK

SEQ ID NO: 4789 - protein, 9 aa, Artificial Sequence
  Synthetic
QHLNSSLLT

SEQ ID NO: 4790 - protein, 119 aa, Artificial Sequence
  Synthetic
QVQLVESGGGVIQPGRSLRLSCAASGFTFSHYGMHWVRQAPGKGLEWVAIISNDGINKYYADSVKGRFTVSRDNSKNTLYLQMNSLRPEDTAVYYCANLITMVWGPPVWGKGTTVTVSS

SEQ ID NO: 4791 - protein, 12 aa, Artificial Sequence
  Synthetic
ANLITMVWGPPV

SEQ ID NO: 4792 - protein, 106 aa, Artificial Sequence
  Synthetic
DIQMTQSPSSLSASVGDRVTITCRASQSISSYLNWYQHKPGKAPKLLIYGASTVQSGVPSNFSGSGSGTDFTLTISSLQPEDFATYYCQQSYSIPLTFGGGTKVEI

SEQ ID NO: 4793 - protein, 9 aa, Artificial Sequence
  Synthetic
QQSYSIPLT

SEQ ID NO: 4794 - protein, 122 aa, Artificial Sequence
  Synthetic
EVQLLESGGGLVQPGGSLRLSCAASGFTFSSYTMSWVRQAQGKGLEWVSGISGSGGIAYYADSVKGRFTISRDNSRNTLYLQMNSLRAEDTALYYCAKDYGTTVTTEVADYWGQGTLVTVSS

SEQ ID NO: 4795 - protein, 15 aa, Artificial Sequence
  Synthetic
AKDYGTTVTTEVADY

SEQ ID NO: 4796 - protein, 107 aa, Artificial Sequence
  Synthetic
DIQMTQSPSSLSASVGDRVTITCRASQSISTYLNWYQQKPGKAPKLLIYAASSLRSGVPSRFSGSGSGTDFTLTISSLQPEDCATYYCQQSYTTPPTFGRGTKLEIK

SEQ ID NO: 4797 - protein, 9 aa, Artificial Sequence
  Synthetic
QQSYTTPPT

SEQ ID NO: 4798 - protein, 127 aa, Artificial Sequence
  Synthetic
QVQLQESGPGLVKPSQTLSLTCTVSGASISNGAYYWSWIRQPPGKGLEWIGYIYYSGSTYYNPSLKSRVTISVDTSKNQFSLKLSSVTAADTAVYYCAQTYYYDSSGSYFQYYFDYWGQGTLVTVSS

SEQ ID NO: 4799 - protein, 19 aa, Artificial Sequence
  Synthetic
AQTYYYDSSGSYFQYYFDY

SEQ ID NO: 4800 - protein, 108 aa, Artificial Sequence
  Synthetic
EIVLTQSPGTLSLSPGERATLSCRASLSVSSSYLAWYQQKPGQAPRLLIYGASSRATGIPDRFSGSGSGTDFTLTISRLEPEDFAVYYCQQYGSSPLTFGGGTKVEIK

SEQ ID NO: 4801 - protein, 9 aa, Artificial Sequence
  Synthetic
QQYGSSPLT

SEQ ID NO: 4802 - protein, 122 aa, Artificial Sequence
  Synthetic
QVQLVQSGAEVKKPGASVKVSCKASEYTFTNYYMHWVRQAPGQGLEWMGIINPSGGSTTYAQKFQGRLTMTGDTSTSTVYMELSSLTSDDTAVYYCARGGVVPAASGEFDYWGQGTLVTVSS

SEQ ID NO: 4803 - protein, 15 aa, Artificial Sequence
  Synthetic
ARGGVVPAASGEFDY

SEQ ID NO: 4804 - protein, 108 aa, Artificial Sequence
  Synthetic
DIQMTQSPSSLSASVGDRVTITCRASQSISRYLNWYQQKPGKAPKLLIYAASSLQSGVPSRFSGSGSGTDFTLTISSLQPEDSATYHCQQTYSAPPVTFGQGTKLEIK

SEQ ID NO: 4805 - protein, 10 aa, Artificial Sequence
  Synthetic
QQTYSAPPVT

SEQ ID NO: 4806 - protein, 122 aa, Artificial Sequence
  Synthetic
EVQLVESGGGLIQPGGSLRLSCAASGFTVNSNYMSWVRQAPGKGLEWVSFIYSGGSTLYADSVKGRFTISRDNSKNTLYLQMNSLRAEDTAVYYCASLYSSGWYLRGAPQVWGQGTLVTVSS

SEQ ID NO: 4807 - protein, 16 aa, Artificial Sequence
  Synthetic
ASLYSSGWYLRGAPQV

SEQ ID NO: 4808 - protein, 110 aa, Artificial Sequence
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNWPPRSYTFGQGTKLEIK

SEQ ID NO: 4809 - protein, 12 aa, Artificial Sequence
  Synthetic
QQYNNWPPRSYT

SEQ ID NO: 4810 - protein, 122 aa, Artificial Sequence
  Synthetic
EVQLLESGGGLVQPGGSLRLSCVASGFTFSSYAITWVRQAPGKGLEWVSAISGSGGGTFYADSVKGRFTISRDNSKNTLYLQMNSLRAEDAAVYYCAKDIGSKLLVDAFDIWGLGTTVTVSS

SEQ ID NO: 4811 - protein, 15 aa, Artificial Sequence
  Synthetic
AKDIGSKLLVDAFDI

SEQ ID NO: 4812 - protein, 108 aa, Artificial Sequence
  Synthetic
DIQMTQSPSSLSASVGDRVTLTCRASQSISSYLNWYQQKPGKAPKLLIYAASNLQSGVPSRFSGSGSGTDFTLTISSLQPEDFATYYCQQSYSTPPITFGQGTRLEIK

SEQ ID NO: 4813 - protein, 10 aa, Artificial Sequence
  Synthetic
QQSYSTPPIT

SEQ ID NO: 4814 - protein, 126 aa, Artificial Sequence
  Synthetic
EVQLVETGGGLIQPGGSLRLSCAASGFSVSNNYMSWVRQAPGKGLEWLSIIYSGGTTYYADSVKGRFTVSRDKSKNTLNLQLNRLRAEDTAVYYCARAKAAPEGHYYFYYYGLDVWGHGTAVTVSS

SEQ ID NO: 4815 - protein, 20 aa, Artificial Sequence
  Synthetic
ARAKAAPEGHYYFYYYGLDV

SEQ ID NO: 4816 - protein, 105 aa, Artificial Sequence
  Synthetic
DIQMTQSPLSASVGDRVTITCRASESISSYLAWYQQTPGKAPKLLMYKTSILESGVPSRFSGSGSGTEFTLTISSLQPDDFATYYCQHYNTYSYTFGQGTKLEIK

SEQ ID NO: 4817 - protein, 9 aa, Artificial Sequence
  Synthetic
QHYNTYSYT

SEQ ID NO: 4818 - protein, 117 aa, Artificial Sequence
  Synthetic
EVQLVETGGGLIQPGGSLRLSCAASGFSVNFNYMSWVRQAPGKGLEWVYTGCSTWRAEEVKSSFGISRDNSKNTVYLQMNSLRAEDTAVYYCARSRYTGSRGAFDIWGQGTMVTVSS

SEQ ID NO: 4819 - protein, 14 aa, Artificial Sequence
  Synthetic
ARSRYTGSRGAFDI

SEQ ID NO: 4820 - protein, 108 aa, Artificial Sequence
  Synthetic
DIQMTQSPSSLSASVGDRVTITCQASQDINNYLNWYQQKPGKAPKLLIYDASNLETGVPSRFSGSGSGTDFTFTISSLQPEDIATYYCQQYDNLPPVTFGPGTKVDFK

SEQ ID NO: 4821 - protein, 10 aa, Artificial Sequence
  Synthetic
QQYDNLPPVT

SEQ ID NO: 4822 - protein, 124 aa, Artificial Sequence
  Synthetic
QVQLVESGGGVVQPGRSLRLSCAASGFTFSSYVMHWVRQAPGKGLEWVAVILYDGSNKYYTDSVKGRFTISRDNSKNTLYLQMNSLRAEDTAVYYCAREKQWLMTNYYYYMDVWGNGTTVTVSS

SEQ ID NO: 4823 - protein, 17 aa, Artificial Sequence
  Synthetic
AREKQWLMTNYYYYMDV

SEQ ID NO: 4824 - protein, 108 aa, Artificial Sequence
  Synthetic
EIVLTQSPATLSLSPGERATLSCRASQSVSTYLAWYQQKPGQAPRLLIYHASNRATGIPARFSGSGSGTDFTLTISSLEPEDSAVYYCQQRSNWPMYTFGQGTKLEIK

SEQ ID NO: 4825 - protein, 10 aa, Artificial Sequence
  Synthetic
QQRSNWPMYT

SEQ ID NO: 4826 - protein, 119 aa, Artificial Sequence
  Synthetic
QVQLVQSGAEVKKPGASVKISCKASGYNFTTYYMNWVRQAPGQGLEWMGIINRSDGTTNHAQKFQGRVTMTRDTSTSTVYMELSSLRSEDTAVYYCAWGWNSIDAFDIWGQGTMVTVSS

SEQ ID NO: 4827 - protein, 12 aa, Artificial Sequence
  Synthetic
AWGWNSIDAFDI

SEQ ID NO: 4828 - protein, 107 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKVEIK

SEQ ID NO: 4829 - protein, 9 aa, Artificial Sequence
  Synthetic
QQYNSYSRT

SEQ ID NO: 4830 - protein, 125 aa, Artificial Sequence
  Synthetic
QVQLVQSGAEVKKPGASVKVSCKVSGYTLTELAIHWVRQAPGKGLEWMGGFDPEDGETIYAQKFQGRVTMTADTTTDTAYMELRSLRSEDTAVYYCATDLMVRGVTPLLGYMDIWGKGTTVTVSS

SEQ ID NO: 4831 - protein, 18 aa, Artificial Sequence
  Synthetic
ATDLMVRGVTPLLGYMDI

SEQ ID NO: 4832 - protein, 107 aa, Artificial Sequence
  Synthetic
DIQMTQSPVSLSASVGDRVTITCRASQSISRYLNWYQQKPGNAPNLLIYAASSLQSGVPSRFSGSGSGTDFTLTISSLQPEDFATYYCQQSYSTPRTFGQGTKVEIK

SEQ ID NO: 4833 - protein, 9 aa, Artificial Sequence
  Synthetic
QQSYSTPRT

SEQ ID NO: 4834 - protein, 127 aa, Artificial Sequence
  Synthetic
EVQLLESGGGLVQPGGSLRLSCAASGFTFSSYAMSWVRQAPGKGLEWVSVISGTGAYTYYADSVKGRFTISRDNSKNTMYLQMNSLRADDTAVYYCAKDGMEWVLVDYYDYSGMDVWGQGTTVTVSS

SEQ ID NO: 4835 - protein, 20 aa, Artificial Sequence
  Synthetic
AKDGMEWVLVDYYDYSGMDV

SEQ ID NO: 4836 - protein, 112 aa, Artificial Sequence
  Synthetic
DIVMTQTPLSSPVTLGQPASISCRSSQSLVHSDGNTYLSWLQQRPGQPPRLLIYKLSNRFSGVPDRFSGSGAGTHFTLKISRVEAEDVGVYYCMQATQFPPTFGQGTKVEIK

SEQ ID NO: 4837 - protein, 9 aa, Artificial Sequence
  Synthetic
MQATQFPPT

SEQ ID NO: 4838 - protein, 126 aa, Artificial Sequence
  Synthetic
EVQLVETGGGLIQPGGSLRLSCAASGFSVSNNYMSWVRQAPGKGLEWLSIIYSGGTTYYADSVKGRFTISRDKSKNTLNLQLNRLRAEDTAVYYCARAKAAPEGHYYFYYYGLDVWGHGTAVTVSS

SEQ ID NO: 4839 - protein, 20 aa, Artificial Sequence
  Synthetic
ARAKAAPEGHYYFYYYGLDV

SEQ ID NO: 4840 - protein, 107 aa, Artificial Sequence
  Synthetic
DIQMTQSPSTLSASVGDRVTITCRASESISSYLAWYQQTPGKAPKLLMYKTSILESGVPSRFSGSGSGTEFTLTISSLQPDDFATYYCQHYNTYSYTFGQGTKLEIK

SEQ ID NO: 4841 - protein, 9 aa, Artificial Sequence
  Synthetic
QHYNTYSYT

SEQ ID NO: 4842 - protein, 118 aa, Artificial Sequence
  Synthetic
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGGWYEFDYWGQGTLVTVSS

SEQ ID NO: 4843 - protein, 11 aa, Artificial Sequence
  Synthetic
ARQGGWYEFDY

SEQ ID NO: 4844 - protein, 93 aa, Artificial Sequence
  Synthetic
DIQMTQSVSLSASVGDRVTITCRASQGIRNDLGWYQQKPGKAPKRLIYAASSLQSGVPSRFSGSGSGTEFTLTISSLQPEDFATYYCLQQEIK

SEQ ID NO: 4845 - skipped

SEQ ID NO: 4846 - protein, 125 aa, Artificial Sequence
  Synthetic
QLQLQESGPGLVKPSETLSLTCTVSGGSISSSRYYWGWIRQPPGKGLEWIGSIYYSGSTHHNPSLMSRVTMSVDASKNQFSLKLTSVTAADTAVYYCARLLSPNHYYDSGSYYLVGQGTLVTVSS

SEQ ID NO: 4847 - skipped

SEQ ID NO: 4848 - protein, 113 aa, Artificial Sequence
  Synthetic
DIVMTQSPDSLAVSLGERATINCKSSQSVLYSSNNKNYLAWYQQKPGQPPKLLIYWASTRESGVPDRFSGSGSETDFTLTISSLQAEDVAIYYCQQYYSTPLTFGGGTKVEIK

SEQ ID NO: 4849 - protein, 9 aa, Artificial Sequence
  Synthetic
QQYYSTPLT

SEQ ID NO: 4850 - protein, 120 aa, Artificial Sequence
  Synthetic
EVQLLESGGGLVQPGGSLRLSCAASGFTFSSYAMSWVRQAPGKGLEWVSAISGSGGARNYADSVKGRFTISRDNSKNTLYLQMNSLRGEDTAVYYCLSPPVLRRSWFDPWGQGTLVTVSS

SEQ ID NO: 4851 - protein, 13 aa, Artificial Sequence
  Synthetic
LSPPVLRRSWFDP

SEQ ID NO: 4852 - protein, 110 aa, Artificial Sequence
  Synthetic
DIVMTQSPLAVSLGERATINCKSSQSVLYSSNNKNSLAWYQQKPGQPPKLLIYWASTRESGVPDRFSGSGSGTDFTLTISSLQAEDVAVYYCQQYYSWFTFGPGTKVDIK

SEQ ID NO: 4853 - protein, 8 aa, Artificial Sequence
  Synthetic
QQYYSWFT

SEQ ID NO: 4854 - protein, 120 aa, Artificial Sequence
  Synthetic
EVQLVQSGAEVKKPGESLKISCKGSGYSFTSYWIGWVRQMPGKGLEWMGVIDPGDSETRYSPSFQGQVTISADKSISTAYLQWSSLKASDTAIYYCARLLCGGDCPFEYWGQGTLVTVSS

SEQ ID NO: 4855 - protein, 13 aa, Artificial Sequence
  Synthetic
ARLLCGGDCPFEY

SEQ ID NO: 4856 - protein, 108 aa, Artificial Sequence
  Synthetic
EIVLTQSPATLSLSPGERATLSCGASQSVSSSSLAWYQQKPGLAPRLLIYDASTRATGIPNRFSGSGSGTDFTLTISRLEPEDFALYYCQQYGYSPRTFGQGTRLEIK

SEQ ID NO: 4857 - protein, 9 aa, Artificial Sequence
  Synthetic
QQYGYSPRT

SEQ ID NO: 4858 - protein, 123 aa, Artificial Sequence
  Synthetic
QVQLQQWGAGLLKPSETLSLTCAVYGGSFSGYYWSWIRQPPGKGLEWIGEINHSRSTNYNPSLKSRVTISVDTSKNQFSLKLSSVTAADTAVYYCARHEGVPGESYFDAFDIWGQGTMVTVSS

SEQ ID NO: 4859 - protein, 17 aa, Artificial Sequence
  Synthetic
ARHEGVPGESYFDAFDI

SEQ ID NO: 4860 - protein, 108 aa, Artificial Sequence; identical to SEQ ID NO: 3556
  Synthetic

SEQ ID NO: 4861 - protein, 9 aa, Artificial Sequence
  Synthetic
QQYGSSPRT

SEQ ID NO: 4862 - protein, 118 aa, Artificial Sequence
  Synthetic
EVQLVETGGGLIQPGGSLRLSCAASGLTVSSNYMSWVRQAPGKGLEWVSIIYSGGSTYYADSVKGRFNISRDNSKNTLYLQMNSLRAEDTAVYYCARGGSYYYGMDVWGQGTTVTVSS

SEQ ID NO: 4863 - protein, 12 aa, Artificial Sequence
  Synthetic
ARGGSYYYGMDV

SEQ ID NO: 4864 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNGIPLPTFGGGTKVEIK

SEQ ID NO: 4865 - protein, 10 aa, Artificial Sequence
  Synthetic
QQLNGIPLPT

SEQ ID NO: 4866 - protein, 126 aa, Artificial Sequence
  Synthetic
QVQLVQSGAEVKKPGSSVKVSCKTSGVTFSSYSFSWIRQAPGQGLEWMGRIIPILGRTNYAQKFQGRVTITADKPTSTAYMELSSLRSEDTAVYYCARDQYYDNSGYYYFYYFDYWGQGTLLTVSS

SEQ ID NO: 4867 - protein, 19 aa, Artificial Sequence
  Synthetic
ARDQYYDNSGYYYFYYFDY

SEQ ID NO: 4868 - protein, 106 aa, Artificial Sequence
  Synthetic
DIQMTQSPSSLSASVGDRVTITCRASQSISSYLSWYQQKPGKAPNLLIYAASTLQSGVPLRFSGSGSGTDFTLTISSLQFEDFATYYCQQSYSTPETFGGGTKVEI

SEQ ID NO: 4869 - protein, 9 aa, Artificial Sequence
  Synthetic
QQSYSTPET

SEQ ID NO: 4870 - protein, 122 aa, Artificial Sequence
  Synthetic
EVQLVESGGGVIQPGGSLRLSCAASGFTVSSNYMGWVRQAPGKGLEWVSFIYTGDATYYADSVKGRFTISTDNSKNTLYLQMNSLRAEDTAVYYCASLYTSGWNFRGAPQVWGRGTMVIVSS

SEQ ID NO: 4871 - protein, 16 aa, Artificial Sequence
  Synthetic
ASLYTSGWNFRGAPQV

SEQ ID NO: 4872 - protein, 110 aa, Artificial Sequence
  Synthetic
EIVMTQSPATLSVSPGERATLSCRASQSVSSHLAWYQQKPGQAPRLLIYGASTRATGIPARFSGSGSGTEFTLTISSLQSEDFAVYYCQQYNNWPPRSYTFGQGTKLEIK

SEQ ID NO: 4873 - protein, 12 aa, Artificial Sequence
  Synthetic
QQYNNWPPRSYT

SEQ ID NO: 4874 - protein, 127 aa, Artificial Sequence
  Synthetic
EVQLVESGGGLVKPGRSLRLSCTASGFTFGDYGMSWFRQAPGKGVERVGFIRSNAYGGTTQYAASVKGRFTISRDDSKSIAYLQMNSLKTEDTAVYYCTRDYRYCSRTSCGYYFDYWGQGTLVTVSS

SEQ ID NO: 4875 - protein, 18 aa, Artificial Sequence
  Synthetic
TRDYRYCSRTSCGYYFDY

SEQ ID NO: 4876 - protein, 108 aa, Artificial Sequence
  Synthetic
DIQLTQSPSSLSASVGDRVTITCRVSQGISSYLNWYRQKPGKVPKLLMYTHPICNLESHLGSVAVDLGQISLSLSAACSLKMLQLITVSGLSMPLRALLARGPSWRSN

SEQ ID NO: 4877 - protein, 10 aa, Artificial Sequence
  Synthetic
SGLSMPLRAL

SEQ ID NO: 4878 - protein, 122 aa, Artificial Sequence
  Synthetic
EVQLVESGGGLIQPGGSLRLSCAASGFTVSYSYMSWVRQAPGTGLEWVSFLYSGGSSYYADSVKGRFTISSDNSKNTMYLQMNSLRAEDTAVYYCASLYSSGYYFRGAPQVWGQGTMVTVSS

SEQ ID NO: 4879 - protein, 16 aa, Artificial Sequence
  Synthetic
ASLYSSGYYFRGAPQV

SEQ ID NO: 4880 - protein, 110 aa, Artificial Sequence; identical to SEQ ID NO: 4708
  Synthetic

SEQ ID NO: 4881 - protein, 12 aa, Artificial Sequence
  Synthetic
QQYNNWPPRSYT

SEQ ID NO: 4882 - protein, 122 aa, Artificial Sequence
  Synthetic
EVQLVESGGGLIQPGGSLRLSCAASGFTVSSDYMSWVRQAPGKGLEWVSFIYSGGATYYAASVKGRFIISRDNSKNTLYLQMNSLRAEDTAVYYCASLYSSGWDLRGAPQVWGQGTMVTVSS

SEQ ID NO: 4883 - protein, 16 aa, Artificial Sequence
  Synthetic
ASLYSSGWDLRGAPQV

SEQ ID NO: 4884 - protein, 110 aa, Artificial Sequence; identical to SEQ ID NO: 4808
  Synthetic

SEQ ID NO: 4885 - protein, 12 aa, Artificial Sequence
  Synthetic
QQYNNWPPRSYT

SEQ ID NO: 4886 - protein, 121 aa, Artificial Sequence
  Synthetic
QVQLVESGGGVVQPGRSLRLSCAASGFTFSSYGMHWVRQAPGKGLEWVAGISYDGSNKYYADSVKGRFTISRDNSKNTMYLQMNSLRAEDTAVYYCAKQIFGYSEYYFDYWGQGTLVTVSS

SEQ ID NO: 4887 - protein, 14 aa, Artificial Sequence
  Synthetic
AKQIFGYSEYYFDY

SEQ ID NO: 4888 - protein, 108 aa, Artificial Sequence
  Synthetic
DIQMTQSPSSLSASVGDRVTITCQASQDISNYLYWYQQKPGKAPKLLIYDASNLEAGVPSRFSGSGSGTDFTLTISSLQTEDIATYYCQQYDNFPPITFGQGTRLEIK

SEQ ID NO: 4889 - protein, 10 aa, Artificial Sequence
  Synthetic
QQYDNFPPIT

SEQ ID NO: 4890 - protein, 126 aa, Artificial Sequence
  Synthetic
EVQLVESGGGLVQPGGSLRLSCAASGFTFSRYDMHWVRQATGKGLEWVSAIGTAGDPYYPGSVKGRFTISRENAKNSLYLQMNSLRAGDTAVYYCARGEMDTATRWGYYYYYMDVWGKGTTVTVSS

SEQ ID NO: 4891 - protein, 20 aa, Artificial Sequence
  Synthetic
ARGEMDTATRWGYYYYYMDV

SEQ ID NO: 4892 - protein, 108 aa, Artificial Sequence
  Synthetic
DIQMTQSPSSLSASVGDRVTITCRASQSISSYLNWYQQKPGKAPNLLIYAASSLQSGVPSRFSGSGSGTDFTLTISSLQPEDFATYYCQQSYSTPPYTFGQGTKLEIK

SEQ ID NO: 4893 - protein, 10 aa, Artificial Sequence
  Synthetic
QQSYSTPPYT

SEQ ID NO: 4894 - protein, 120 aa, Artificial Sequence
  Synthetic
QVQLQESGPGLVKPSQTLSLTCTVSGGSISRGGYYWSWIRQHPGKGLEWIGYIYYSGSTYFNPSLKSRATMSVDTSKNQFSLNLSSVTGADTAVYYCARGGGTLGFFDYWGQGTLVTVSS

SEQ ID NO: 4895 - protein, 12 aa, Artificial Sequence
  Synthetic
ARGGGTLGFFDY

SEQ ID NO: 4896 - protein, 107 aa, Artificial Sequence
  Synthetic
DIQMTQSPSSLSASVGDRVTITCQASQGIRNYLNWYQQKPGKAPKLLIYDASNLETGVPSRFSGSGSGTDFTFTISSLEPEDFATYYCQQYDNLRFTFGPGTKVDIK

SEQ ID NO: 4897 - protein, 9 aa, Artificial Sequence
  Synthetic
QQYDNLRFT

SEQ ID NO: 4898 - protein, 127 aa, Artificial Sequence
  Synthetic
QVQLQESGPGLVKPSQTLSLTCTVSGGSISSGNYYWSWIRQHPGKGLEWIGFIYYSGSTYYNPSLKSRVTVSIDTSKNQFSLKLSSVTAADTAIYYCARDKLMVYASAGARGPFDPWGQGTLVTVSS

SEQ ID NO: 4899 - protein, 19 aa, Artificial Sequence
  Synthetic
ARDKLMVYASAGARGPFDP

SEQ ID NO: 4900 - protein, 113 aa, Artificial Sequence
  Synthetic
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPWTFGQGTKVEIK

SEQ ID NO: 4901 - protein, 9 aa, Artificial Sequence
  Synthetic
MQRIEFPWT

SEQ ID NO: 4902 - protein, 124 aa, Artificial Sequence
  Synthetic
QVQLVESGGGVVQPGRSLRLSCAASGFTFSSYVMHWVRQAPGKGLEWVALISYDGSNKYYADSVKGRFTISRDNSKNTQYVQMNSLRAEDTAVYYCAREKVSVQVGYPYYMDAWGKGTTVTVSS

SEQ ID NO: 4903 - protein, 17 aa, Artificial Sequence
  Synthetic
AREKVSVQVGYPYYMDA

SEQ ID NO: 4904 - protein, 106 aa, Artificial Sequence
  Synthetic
EIVLTQSPATLSLSPGERATLSCRASQSVSSYLAWYQQKPGQAPRLLIYGASNRATGIPARFSGSGSGTDFTLTISSLEPEDFAVYYCQERSSWYTFGQGTKLEIK

SEQ ID NO: 4905 - protein, 8 aa, Artificial Sequence
  Synthetic
QERSSWYT

SEQ ID NO: 4906 - protein, 126 aa, Artificial Sequence
  Synthetic
QVQLQQWGAGLLKPSETLSLTCAFYGGSFSGYYWNWIRQSPGKGLEWIGEINHSGSTNYNPSLKSRVSISVDTSKNQFSLKLSSVTAADTAVYYCARGHYDSSGYYYSYYYGVDVWGQGTMVTVSS

SEQ ID NO: 4907 - protein, 20 aa, Artificial Sequence
  Synthetic
ARGHYDSSGYYYSYYYGVDV

SEQ ID NO: 4908 - protein, 112 aa, Artificial Sequence
  Synthetic
DIVMTQSPLSLPVTPGEPASISCRSSRTLLHSSGNNHLDWYLQKPGQSPQLLIYLGSNRASGVPDRFSGSGSGADFTLKISRVEAEDVGVYYCMQGLQTPLTFGQGTRLEIK

SEQ ID NO: 4909 - protein, 9 aa, Artificial Sequence
  Synthetic
MQGLQTPLT

SEQ ID NO: 4910 - protein, 123 aa, Artificial Sequence
  Synthetic
QVQLVESGGGVVQPGRSLRLSCAASGFTFSRYGIHWVRQAPGKGLEWVAVVSYDGSDKYYADSVKGRFTISRDNSKNTLYLQMNSLRAEDTAVYYCAKSGFGYSYGYYYFDYWGQGTLVTVSS

SEQ ID NO: 4911 - protein, 16 aa, Artificial Sequence
  Synthetic
AKSGFGYSYGYYYFDY

SEQ ID NO: 4912 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTIISLQPEDIATYYCQQSDYLPITFGQGTRLEIK

SEQ ID NO: 4913 - protein, 9 aa, Artificial Sequence
  Synthetic
QQSDYLPIT

SEQ ID NO: 4914 - protein, 122 aa, Artificial Sequence
  Synthetic
EVQLVESGGGLIQPGGSLRLSCAASGFTVNSNYMSWVRQAPGKGLEWVSFIYSDPATYYADSVKGRFTISRDNSKNTLYLQMNSLRAEDTAVYYCASLYSSGWYLRGAPQVWGQGTMVTVSS

SEQ ID NO: 4915 - protein, 16 aa, Artificial Sequence
  Synthetic
ASLYSSGWYLRGAPQV

SEQ ID NO: 4916 - protein, 110 aa, Artificial Sequence; identical to SEQ ID NO: 4708
  Synthetic

SEQ ID NO: 4917 - protein, 12 aa, Artificial Sequence
  Synthetic
QQYNNWPPRSYT

SEQ ID NO: 4918 - protein, 122 aa, Artificial Sequence
  Synthetic
EVQLVESGGGLVQPGGSLRLSCAASGFTVSRNYMSWVRQAPGKGLEWVSVIYSGGSTFYADSVKGRFTISRDNSKNTLYLQMNSLRAEDTAVYSCAREGGLGKGVTGTTGFDYWGQGTLVTV

SEQ ID NO: 4919 - protein, 18 aa, Artificial Sequence
  Synthetic
AREGGLGKGVTGTTGFDY

SEQ ID NO: 4920 - protein, 108 aa, Artificial Sequence
  Synthetic
DIQMTQSPSSLSASVGDRVTITCRASQSISNHLNWYQQKPGKAPKLLIYAASSLHSGVPSRFSGSGSGTDFTLTISSLQPEDFANYFCQQSYSTPPYTFGQGTKLEIK

SEQ ID NO: 4921 - protein, 10 aa, Artificial Sequence
  Synthetic
QQSYSTPPYT

SEQ ID NO: 4922 - protein, 127 aa, Artificial Sequence
  Synthetic
QVQLVQSGAEVKKVGSSVKVSCKASGGTFSSSSINWVRQAPGQGLEWMGRIIPILGIANYAQNFQGRVTITADKSTSTAYMELRSLRSEDTAVYYCARDPTPTRITIFGVVPYFDYWGQGTLVTVSS

SEQ ID NO: 4923 - protein, 20 aa, Artificial Sequence
  Synthetic
ARDPTPTRITIFGVVPYFDY

SEQ ID NO: 4924 - protein, 107 aa, Artificial Sequence
  Synthetic
DIQMTQSPSSLSASVGDRVTITCRASQNISSYLNWYQQKPEKAPKLLIYAASSLQSGVPSRFSGSGSGTDFTLTISSLQPEDFATYYCQQTYSTPRGFGQGTKVEIK

SEQ ID NO: 4925 - protein, 9 aa, Artificial Sequence
  Synthetic
QQTYSTPRG

SEQ ID NO: 4926 - protein, 127 aa, Artificial Sequence
  Synthetic
QVQLVESGGGVVQPGRSLRLSCTASGFTFSHYGMQWVRQAPGKGLEWVTVISYDGSNKYYADSVKGRFTISRDNSKNTLYLQMNSLRAEDTAVYYCAKSGGTYCSGGNCYLYYFDYWGQGTLVTVSS

SEQ ID NO: 4927 - protein, 20 aa, Artificial Sequence
  Synthetic
AKSGGTYCSGGNCYLYYFDY

SEQ ID NO: 4928 - protein, 107 aa, Artificial Sequence
  Synthetic
DIQMTQSPSSLSASVGDRVTITCQASQGITNYLNWYQQKLGKAPKLLIYDASNLETGVPSRFSGSGSGTDFTLTISSLQPEDIATYYCQQYDNLPITFGQGTRLEIK

SEQ ID NO: 4929 - protein, 9 aa, Artificial Sequence
  Synthetic
QQYDNLPIT

SEQ ID NO: 4930 - protein, 129 aa, Artificial Sequence
  Synthetic
QVQLVESGGGVVQPGRSLRLSCATSGFIFSSYAMHWVRQAPGKGLEWVATISYDGSNTYYADSVKGRFTISRDNSKNTLYLQMNSLRAEDTAVYYCARSPRGYYDRTGYYHLEYYFDYWGQGTLVSVSS

SEQ ID NO: 4931 - protein, 22 aa, Artificial Sequence
  Synthetic
ARSPRGYYDRTGYYHLEYYFDY

SEQ ID NO: 4932 - protein, 108 aa, Artificial Sequence
  Synthetic
EIVMTQSPATLSVSPGERATLSCRASQSVSSNLAWYQQKPGQAPRLLIYGASTRATGIPAFSGSGSGTDFTLTISSLQSADFAVYYCQQYNNWPPGGTFGQGTKVEIK

SEQ ID NO: 4933 - protein, 11 aa, Artificial Sequence
  Synthetic
QQYNNWPPGGT

SEQ ID NO: 4934 - protein, 126 aa, Artificial Sequence
  Synthetic
QVQLQESGPGLVKPSETLSLTCTVSGGSVSSYYWSWIRQPPGKGLEWIGYIYYSGSTNYNPSLKSRVTISVDTSRNQISLKLSSVTAADTAVYYCARHRLLSRGWYEYPVWYFDVWGRGTLVTVSA

SEQ ID NO: 4935 - protein, 20 aa, Artificial Sequence
  Synthetic
ARHRLLSRGWYEYPVWYFDV

SEQ ID NO: 4936 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTIGSLQPEDFATYYCQQGYRNFPITFGQGTRLEIK

SEQ ID NO: 4937 - protein, 10 aa, Artificial Sequence
  Synthetic
QQGYRNFPIT

SEQ ID NO: 4938 - protein, 128 aa, Artificial Sequence
  Synthetic
QVQLVESGGGVVQPGRSLRLSCAASGFTFSKYGMHWVRQAPGKGLEWVAVMSYDGSNKYYTDSVKGRFTISRDNSKNTLFLQMNSLRAEDTAVYYCAKAGGGPYCGGGNCYLNYFDYWGQGTLVTVSS

SEQ ID NO: 4939 - protein, 21 aa, Artificial Sequence
  Synthetic
AKAGGGPYCGGGNCYLNYFDY

SEQ ID NO: 4940 - protein, 107 aa, Artificial Sequence
  Synthetic
DIQMTQSPSSLSASIGDRVTITCQASQDISNSLNWYQQKPGKAPKLLIYDASNLETGVPSRFSGSRSGTDFTFTITSLQPEDIATYYCQQYDNLPITFGQGTRLEIK

SEQ ID NO: 4941 - protein, 9 aa, Artificial Sequence
  Synthetic
QQYDNLPIT

SEQ ID NO: 4942 - protein, 126 aa, Artificial Sequence
  Synthetic
QVQLVQSGAEVKKPGASVKVSCKASGYTFTGYYMHWVRQAPGQGLEWMGWINPNTGGTNYAQKFQGRVTMTRDTSISTAYMELNRLRSDDTAVYYCARKRFRYYDGRDWFPPADYWGQGTLVTVSS

SEQ ID NO: 4943 - protein, 19 aa, Artificial Sequence
  Synthetic
ARKRFRYYDGRDWFPPADY

SEQ ID NO: 4944 - protein, 112 aa, Artificial Sequence
  Synthetic
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 4945 - protein, 9 aa, Artificial Sequence
  Synthetic
MQALQTPLT

SEQ ID NO: 4946 - protein, 122 aa, Artificial Sequence
  Synthetic
EVQLVESGGGLIQPGGSLRLSCAASGLPVSDNYMNWVRQAPGKGLEWVSVIYSGGSTVYADSVKGRFTISRDNSKNTLYLQMNSLRAEDTAVYYCASLYSFGWNLRGAPQVWGQGTMVTVSS

SEQ ID NO: 4947 - protein, 16 aa, Artificial Sequence
  Synthetic
ASLYSFGWNLRGAPQV

SEQ ID NO: 4948 - protein, 110 aa, Artificial Sequence; identical to SEQ ID NO: 4808
  Synthetic

SEQ ID NO: 4949 - protein, 12 aa, Artificial Sequence
  Synthetic
QQYNNWPPRSYT

SEQ ID NO: 4950 - protein, 130 aa, Artificial Sequence
  Synthetic
QVQLQESGPGLVKPSQTLSLTCTVSGGSISSGGYYWSWIRQHPGKGLEWIGYIYYSGSTYYNPSLKSRVTISVDTSKNQFSLRLSSVTAADTAVYYCARDSSVERYYDSSGYWKPLFDPWGQGTLVTVSS

SEQ ID NO: 4951 - protein, 22 aa, Artificial Sequence
  Synthetic
ARDSSVERYYDSSGYWKPLFDP

SEQ ID NO: 4952 - protein, 112 aa, Artificial Sequence
  Synthetic
DIVMTQSPLSLPVTPGEPASISCRSSQSLLHTNGYNYLDWYLQKPGQSPQLLMYLGSKRASGVPGRFSGSGSGTDFTLRISRVEAEDVGVYYCMQALQTPPTFGQGTKVEIK

SEQ ID NO: 4953 - protein, 9 aa, Artificial Sequence
  Synthetic
MQALQTPPT

SEQ ID NO: 4954 - protein, 130 aa, Artificial Sequence
  Synthetic
QVQLVQSGAEVKKPGASVKVSCKASGYSFPGYYMHWVRQAPGQGLEWMGWINPNNGGTNYAQKFQGRVTMTRDTSISTAYMELSRLRSDDTAMYYCARVIRRPGYNINWTGDYYYGMDVWGQGTTVTVSS

SEQ ID NO: 4955 - protein, 23 aa, Artificial Sequence
  Synthetic
ARVIRRPGYNINWTGDYYYGMDV

SEQ ID NO: 4956 - protein, 107 aa, Artificial Sequence
  Synthetic
DIQMTQSPSSLSASVGDRVTITCRASQSISNYLNWYQQKPGKAPKFLIYAASSLQSGVPSRFSGSGSGTDFTLTISSLEPEDFATYYCQQSYSSPETFGQGTKVEIK

SEQ ID NO: 4957 - protein, 9 aa, Artificial Sequence
  Synthetic
QQSYSSPET

SEQ ID NO: 4958 - protein, 122 aa, Artificial Sequence
  Synthetic
QLQLQESGPGLVKPAETLSLTCTVSGGSISSSSYYWGWIRQPPGKGLEWIGMIYYSGSTYYNPSLKSRVTISVDTSKNQFSLKLSSVTAADTAVYYCARHQRYGYGGGVDYWGQGTLVTVSS

SEQ ID NO: 4959 - protein, 14 aa, Artificial Sequence
  Synthetic
ARHQRYGYGGGVDY

SEQ ID NO: 4960 - protein, 110 aa, Artificial Sequence
  Synthetic
QSVLTQPASVSGSPGQSITISCTGTSSDVGSYNLVSWYQQHPGKAPKLMIYEGSQRPSGVSNRFSGSKSGNTASLTISGLQAEDEADYYCCSYAGSSTLVFGGGTKLTVL

SEQ ID NO: 4961 - protein, 10 aa, Artificial Sequence
  Synthetic
CSYAGSSTLV

SEQ ID NO: 4962 - protein, 120 aa, Artificial Sequence
  Synthetic
QLQLQESGPGLVKPSETLSLTCTVSGGSISSSSYFWGWIRQPPGKGLEWIGTIYFSGSTYYNPSLKSRVTISVDTSKNQFSLRLSSVTAADTAVYYCARLTWLRGNFDYWGQGTLVTVSS

SEQ ID NO: 4963 - protein, 12 aa, Artificial Sequence
  Synthetic
ARLTWLRGNFDY

SEQ ID NO: 4964 - protein, 110 aa, Artificial Sequence
  Synthetic
NFMLTQPHSVSESPGKTVTISCTGSSGYIASNYVQWYQQRPGSAPTTVIYEDNQRPSGVPDRFSGSIDSSSNSASLTISGLKTEDEADYYCQSYDSANWVFGGGTKLTVL

SEQ ID NO: 4965 - protein, 9 aa, Artificial Sequence
  Synthetic
QSYDSANWV

SEQ ID NO: 4966 - protein, 128 aa, Artificial Sequence
  Synthetic
QVQLVESGGGVVQPGRSLRLSCAASGFTFSSYGMHWVRQAPGKGLEWVAVIWYDGSNKYNADSVKGRFTISRDNSKNTLYLQMNSLRAEDTAVYYCARDSAYCSSTSCHNMTNWFDPWGQGTLVTVSS

SEQ ID NO: 4967 - protein, 21 aa, Artificial Sequence
  Synthetic
ARDSAYCSSTSCHNMTNWFDP

SEQ ID NO: 4968 - protein, 109 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHLWVFGGGTKLTVL

SEQ ID NO: 4969 - protein, 12 aa, Artificial Sequence
  Synthetic
QVWDSSSDHLWV

SEQ ID NO: 4970 - protein, 124 aa, Artificial Sequence
  Synthetic
QVQLVQSGAEVKKPGSSVKVSCKASGGTFSSYTFSWVRQAPGQGLEWMGRIIPILGIADYAQKFQGRVTITADKSTSTAYMELSSLRSEDTAVYYCARDRGYSSSGSNNWFDPWGQGTLVTVSS

SEQ ID NO: 4971 - protein, 17 aa, Artificial Sequence
  Synthetic
ARDRGYSSSGSNNWFDP

SEQ ID NO: 4972 - protein, 111 aa, Artificial Sequence
  Synthetic
QSVLTQPPSVSGAPGQRVTISCTGSSSNIGAGYDVHWYQQLPGTAPKVLIYANSNRPSGVPDRFSGSKSDTSASLAITGLQAEDEADYYCQSYDSSLSGGVFGGGTKLTVL

SEQ ID NO: 4973 - protein, 11 aa, Artificial Sequence
  Synthetic
QSYDSSLSGGV

SEQ ID NO: 4974 - protein, 124 aa, Artificial Sequence
  Synthetic
QVQLVQSGAEVKKPGSSVKVSCKASGGTFSSYPLSWVRQAPGQGLEWMGRIIPILGIANYAQTFQGRVTITAEKYTTTAYMELSSLRSEDTAVYYCARDQGYSGSGSNYYMDVWGKGTTVIVSS

SEQ ID NO: 4975 - protein, 17 aa, Artificial Sequence
  Synthetic
ARDQGYSGSGSNYYMDV

SEQ ID NO: 4976 - protein, 111 aa, Artificial Sequence
  Synthetic
QSVLTQPPSVSGAPGQRVTISCTGSSSNIGAGYDVHWYQHLPGTAPKLLIYGNSNRPSGVPDRFSGSKSDTSASLAITGLQAEDEADYYCQSYDSSLSDYVFGTGTKVTVL

SEQ ID NO: 4977 - protein, 11 aa, Artificial Sequence
  Synthetic
QSYDSSLSDYV

SEQ ID NO: 4978 - protein, 124 aa, Artificial Sequence
  Synthetic
QVQLVESGGGVVQPGKSLRLSCAASGFTFSSFGMHWVRQAPGKGLDWVAGISYDGSNKYCADSVKGRFTISRDNSKNTLYLQMNSLRVEDTAVYYCAKDPRNGISGTTGYFDYWGQGTLVTVSS

SEQ ID NO: 4979 - protein, 17 aa, Artificial Sequence
  Synthetic
AKDPRNGISGTTGYFDY

SEQ ID NO: 4980 - protein, 109 aa, Artificial Sequence; identical to SEQ ID NO: 964
  Synthetic

SEQ ID NO: 4981 - protein, 12 aa, Artificial Sequence
  Synthetic
QVWDSSSDHFWV

SEQ ID NO: 4982 - protein, 129 aa, Artificial Sequence
  Synthetic
QVQLQESGPGLVKPSETLSLTCTVSGGSISSYYWNWIRQPPGKGLEWIGYIYYSGSTNFNPSLESRVTISVDTSKNQFSLNLSSVTAADTAVYYCARETSYYDSSGSFSGSHPYYFDSWGQGTLVTVSS

SEQ ID NO: 4983 - protein, 23 aa, Artificial Sequence
  Synthetic
ARETSYYDSSGSFSGSHPYYFDS

SEQ ID NO: 4984 - protein, 111 aa, Artificial Sequence
  Synthetic
QSVLTQPPSVSGAPGQRVTISCTGRSSNIGAGYDVHWYQQLPGTAPKLLIYANNNRPSGVPDRFSGSNSGTSASLAITGLQAEDEADYYCQSYDSSLTGWVFGGGTKLTVL

SEQ ID NO: 4985 - protein, 11 aa, Artificial Sequence
  Synthetic
QSYDSSLTGWV

SEQ ID NO: 4986 - protein, 132 aa, Artificial Sequence
  Synthetic
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARVGSVTYYDILTGHPPYYYYGMDVWGQGTTVTVSS

SEQ ID NO: 4987 - protein, 25 aa, Artificial Sequence
  Synthetic
ARVGSVTYYDILTGHPPYYYYGMDV

SEQ ID NO: 4988 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVTVL

SEQ ID NO: 4989 - protein, 11 aa, Artificial Sequence
  Synthetic
QSYDSSLSGSV

SEQ ID NO: 4990 - protein, 120 aa, Artificial Sequence
  Synthetic
EVQLLESGGGLVQPGGSLRLSCAASGFTFSSSAMSWVRQAPGKGLEWVSAFSASGGSTYYADSVKGRFTISRDNSKNTLFLQMNSLRAEDTAVYFCAKTNTGWYLGIDYWGPGTLVTVSS

SEQ ID NO: 4991 - protein, 13 aa, Artificial Sequence
  Synthetic
AKTNTGWYLGIDY

SEQ ID NO: 4992 - protein, 111 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVL

SEQ ID NO: 4993 - protein, 10 aa, Artificial Sequence
  Synthetic
QSYDSSNLWV

SEQ ID NO: 4994 - protein, 120 aa, Artificial Sequence
  Synthetic
QLQLQESGPGLVKPSETLSLTCTVSGGSISSSRYYWGWIRQPPGKGLEWIGIIYYSGSTYYNPSLKSRVTISVDTSKNQFSLKLSSVTAADTAVYYCARLMWLRGPFDYWGQGTLVTVSS

SEQ ID NO: 4995 - protein, 12 aa, Artificial Sequence
  Synthetic
ARLMWLRGPFDY

SEQ ID NO: 4996 - protein, 111 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSTHVVFGGGTKLTVL

SEQ ID NO: 4997 - protein, 10 aa, Artificial Sequence
  Synthetic
QSYDSSTHVV

SEQ ID NO: 4998 - protein, 125 aa, Artificial Sequence
  Synthetic
QVQLVESGGGVVQPGRSLRLSCAASAFTFSSYVMHWVRQAPGKGLEWVAVISYDGSNKYYADSVKGRFTISRDNSKNTLYLQMNSLRAEDTAVYYCAKRTSTYGSWSYYNYFDYWGQGTLVTVSS

SEQ ID NO: 4999 - protein, 18 aa, Artificial Sequence
  Synthetic
AKRTSTYGSWSYYNYFDY

SEQ ID NO: 5000 - protein, 111 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNPVVFGGGTKLTVL

SEQ ID NO: 5001 - protein, 10 aa, Artificial Sequence
  Synthetic
QSYDSSNPVV

SEQ ID NO: 5002 - protein, 124 aa, Artificial Sequence
  Synthetic
QVQLVQSGAEVKKPGSSVKVSCKASGVTFSTYTISWMRQAPGQGLEWMGSIIPILGIANYAQKFQGRVTITADKSTSTAYMELSSLRCEDTAVFYCAIERGYSGYGASAYFDYWGQGTLVSVSS

SEQ ID NO: 5003 - protein, 17 aa, Artificial Sequence
  Synthetic
AIERGYSGYGASAYFDY

SEQ ID NO: 5004 - protein, 111 aa, Artificial Sequence; identical to SEQ ID NO: 4252
  Synthetic

SEQ ID NO: 5005 - protein, 11 aa, Artificial Sequence
  Synthetic
QSYDSSLSGSV

SEQ ID NO: 5006 - protein, 120 aa, Artificial Sequence
  Synthetic
QLQLQESGPGLVKPSETLSLTCTVSGGSISSSPYYWGWIRQPPGKGLEWIGSFYYGGSTNYNPSLKSRVTISVDTSKNQFSLKLTSVTAADTAVYYCARREWLRGGFDYWGQGTLVTVSS

SEQ ID NO: 5007 - protein, 12 aa, Artificial Sequence
  Synthetic
ARREWLRGGFDY

SEQ ID NO: 5008 - protein, 110 aa, Artificial Sequence
  Synthetic
NFMLTQPHSVSESPGKTVTISCTGSSGSIASNYVQWYQQRPGSAPTTVIYEDNQRPSGVPERFSGSIDSSSNSASLTISGLKTEDEADYYCQSYDNSNLVFGGGTKLTVL

SEQ ID NO: 5009 - protein, 9 aa, Artificial Sequence
  Synthetic
QSYDNSNLV

SEQ ID NO: 5010 - protein, 120 aa, Artificial Sequence
  Synthetic
QLQLQESGPGLVKPSETLSLTCAVSGGSISSSSYFWGWIRQPPGRGLEWIGNIYYSGTTYYNPSLKSRVTISVDASKNQFSLKLTSVTAADTAVYYCATQGWLRGYFDYWGQGTLVTVSS

SEQ ID NO: 5011 - protein, 12 aa, Artificial Sequence
  Synthetic
ATQGWLRGYFDY

SEQ ID NO: 5012 - protein, 111 aa, Artificial Sequence
  Synthetic
NFMLTQPHSVSESPGKTVTISCTGRSGSIASNYVQWYQQRPGSAPSTVIYEDNQRPSGVPDRFSGSIDSSSNSASLTISGLKTEDEADYYCQSYDSSNLVVFGGGTKLTVL

SEQ ID NO: 5013 - protein, 10 aa, Artificial Sequence
  Synthetic
QSYDSSNLVV

SEQ ID NO: 5014 - protein, 126 aa, Artificial Sequence
  Synthetic
EVQLVESGGGLVQPGRSLRLSCAASGFNFEDYAMHWVRQAPGKGLEWVSGVSWNSGTIGYADSVKGRFTISRDNAKNSMYLQMNRLRAEDTALYYCAKLEGGPYDFWGGSRVMDVWGQGTTVTVSS

SEQ ID NO: 5015 - protein, 19 aa, Artificial Sequence
  Synthetic
AKLEGGPYDFWGGSRVMDV

SEQ ID NO: 5016 - protein, 110 aa, Artificial Sequence
  Synthetic
QFALTQPPSASGTPGQRVTISCGSSSNIGSNTVNWYQQLPGTAPTLLIYSNNQRPSGVPDRFSGSKGTSASLAISGLQCEDEADYYCAAWDDSLNGSYWVFGGGTKLTVL

SEQ ID NO: 5017 - protein, 13 aa, Artificial Sequence
  Synthetic
AAWDDSLNGSYWV

SEQ ID NO: 5018 - protein, 125 aa, Artificial Sequence
  Synthetic
QVQLVESGGGVVQPGRSLRLSCAASGFTFSSYGIHWVRQAPGKGLEWVAITWYYGSNRYYADSVKGRFTISRDNSKNTVYLQMNSLRAEDTAVYYCARDGEYCSGGSCYLGFDYWGQGTLVTVSS

SEQ ID NO: 5019 - protein, 18 aa, Artificial Sequence
  Synthetic
ARDGEYCSGGSCYLGFDY

SEQ ID NO: 5020 - protein, 108 aa, Artificial Sequence
  Synthetic
SYVLTQPPSVSVSPGQTASITCSGDKLGDKYACWYQQRPGQSPVLVIYQDSKRPSGIPERFSGSNSGNTATLTISGTQAMDEADYYCQAWDSSTAGYVFGTGTTVTVL

SEQ ID NO: 5021 - protein, 11 aa, Artificial Sequence
  Synthetic
QAWDSSTAGYV

SEQ ID NO: 5022 - protein, 120 aa, Artificial Sequence
  Synthetic
QVQLQESGPGLVKPSQTLSLTCTVSGGSLSSGGYYWSWIRQHPGKGLEWIGYIYYRGSTFYNPSLKSLVTISVDTSKNQFSLKLSSVTAADTAVYYCARGTFFSWWFDPWGQGTLVTVSS

SEQ ID NO: 5023 - protein, 12 aa, Artificial Sequence
  Synthetic
ARGTFFSWWFDP

SEQ ID NO: 5024 - protein, 108 aa, Artificial Sequence
  Synthetic
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTKVTVL

SEQ ID NO: 5025 - protein, 11 aa, Artificial Sequence
  Synthetic
QVWDSSSDHPV

SEQ ID NO: 5026 - protein, 120 aa, Artificial Sequence
  Synthetic
QLQLQESGPGLVKPSETLSLTCTVSGGSIRSNPYYWGWIRQPPGKGLEWIGIIYYSGTTYYNPSLKSRVTISVDTSKNQFSLKLSSVTAADTAVYYCARLRWLRGDFEYWGQGTLVTVSS

SEQ ID NO: 5027 - protein, 12 aa, Artificial Sequence
  Synthetic
ARLRWLRGDFEY

SEQ ID NO: 5028 - protein, 110 aa, Artificial Sequence
  Synthetic
NFMLTQPLSVSESPGKTVTISCTGSSGSIASNYVQWYQQRPGSAPTTVIYEDNQRPSGVPDRFSGSIDSSSNSASLTISGLKTEDEADYYCQSYDSTNHVFGTGTKVTVL

SEQ ID NO: 5029 - protein, 9 aa, Artificial Sequence
  Synthetic
QSYDSTNHV

SEQ ID NO: 5030 - protein, 114 aa, Artificial Sequence
  Synthetic
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKRFPEYWGQGSLVTVSS

SEQ ID NO: 5031 - protein, 7 aa, Artificial Sequence
  Synthetic
AKRFPEY

SEQ ID NO: 5032 - protein, 110 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVL

SEQ ID NO: 5033 - protein, 9 aa, Artificial Sequence
  Synthetic
QSYDSSNWV

SEQ ID NO: 5034 - protein, 119 aa, Artificial Sequence
  Synthetic
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAPQLWLRGAFDYWGQGTLVTVSS

SEQ ID NO: 5035 - protein, 12 aa, Artificial Sequence
  Synthetic
APQLWLRGAFDY

SEQ ID NO: 5036 - protein, 111 aa, Artificial Sequence
  Synthetic
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHAVFGGGTQLTVL

SEQ ID NO: 5037 - protein, 10 aa, Artificial Sequence
  Synthetic
QSYDSSNHAV

SEQ ID NO: 5038 - protein, 122 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRTEDTAVYYCAKGGWYSSPTYYFDYWGQGTLVTVSS

SEQ ID NO: 5039 - protein, 15 aa, Artificial Sequence
  Synthetic
AKGGWYSSPTYYFDY

SEQ ID NO: 5040 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHLVFGGGTKLTVL

SEQ ID NO: 5041 - protein, 11 aa, Artificial Sequence
  Synthetic
QVWDSSSDHLV

SEQ ID NO: 5042 - protein, 118 aa, Artificial Sequence
  Synthetic
QVQLQQWGAGLLKPSETLSLTCAVYGGSFSDYYWTWIRQPPGKGLEWIGEINHSGGTNFNPSLRSRVTISVDTSKSQFSLNLSSVTAADTAVYYCARVVWLQGEIDYWGQGTLVTVSS

SEQ ID NO: 5043 - protein, 12 aa, Artificial Sequence
  Synthetic
ARVVWLQGEIDY

SEQ ID NO: 5044 - protein, 102 aa, Artificial Sequence
  Synthetic
NFMLTQPHSVSESPGKTVTISCTLSTGCKYQQGHQPQCGSSPGKVTISSTCSSRSIVSVQSSNSASLTISGLKTEDEADYFCQSYDTTIPRVFGGGTKLTVL

SEQ ID NO: 5045 - protein, 10 aa, Artificial Sequence
  Synthetic
QSYDTTIPRV

SEQ ID NO: 5046 - protein, 126 aa, Artificial Sequence
  Synthetic
QLQLQESGPGLVKPSETLSLTCTVSGGSISTNNYYWGWIRQPPGKGLEWIGSIYYSGSTYYNPSLKSRVTISVDTSKNHFSLKLSSVTAADTAVYYCARLGDYVWGSYRPPRFDPWGQGTLVSVSS

SEQ ID NO: 5047 - protein, 18 aa, Artificial Sequence
  Synthetic
ARLGDYVWGSYRPPRFDP

SEQ ID NO: 5048 - protein, 110 aa, Artificial Sequence
  Synthetic
QTVVTQEPSLSVSPGGTVTLTCALSSGSVATSYYPSWYQQTPGQAPRTLIYGTNTRSSGVPDRFSGSILGNKVALTITGAQADDESDYYCVLYMGSGIVVFGGGTKLTVL

SEQ ID NO: 5049 - protein, 10 aa, Artificial Sequence
  Synthetic
VLYMGSGIVV

SEQ ID NO: 5050 - protein, 120 aa, Artificial Sequence
  Synthetic
EVQLVQSGAEVKKPGESLKISCKGSGYSFISYWIGWVRQMPGKGLEWMGIIYPGDSDTRYSPSFQGQVTISADKSISTAYLQWSSLKASDTAMYYCARLSNIPNGYMDVWGKGTTVTVSS

SEQ ID NO: 5051 - protein, 13 aa, Artificial Sequence
  Synthetic
ARLSNIPNGYMDV

SEQ ID NO: 5052 - protein, 110 aa, Artificial Sequence
  Synthetic
QSVLTQPPSASGTPGQRVTISCSGGSSNIGSNTVNWYQQLPGTAPKLLIYSNNQRPSGVPDRFSGSKSGTSASLAISGLQSEDEADYYCAAWDDSLNVVVFGGGTKLTVL

SEQ ID NO: 5053 - protein, 11 aa, Artificial Sequence
  Synthetic
AAWDDSLNVVV

SEQ ID NO: 5054 - protein, 120 aa, Artificial Sequence
  Synthetic
QVQLQQWGAGLLKPSETLSLTCAVYGGSFSGYYWSWIRQPPGKGLEWIGEINHSGSTDYNPSLKSRVTISVDTSKNQFSLKVSSVTAADTAVYYCARDDGGFRELFLDYWGQGTLVTVSS

SEQ ID NO: 5055 - protein, 14 aa, Artificial Sequence
  Synthetic
ARDDGGFRELFLDY

SEQ ID NO: 5056 - protein, 109 aa, Artificial Sequence
  Synthetic
QSVLTQPPSASGTPGQRVTISCSGSSSNIGTNYVYWYQQLPGTAPKLLIYRNNQRPSGVPDRFSGSKSGTSASLAISGLRSEDEADYYCAAWDDSLRGVFGGGTKLTVL

SEQ ID NO: 5057 - protein, 10 aa, Artificial Sequence
  Synthetic
AAWDDSLRGV

SEQ ID NO: 5058 - protein, 120 aa, Artificial Sequence
  Synthetic
QLQLQESGPGLVKPSETLSLTCTVSGGSISTSSYYWGWIRQPPGKGLEWVGIIYYSGSTYYNPSLKSRVTISVDTSKNQFSLKLSSVTAADTAVYYCARLMWLRGPFDYWGQGTLVTVSS

SEQ ID NO: 5059 - protein, 12 aa, Artificial Sequence
  Synthetic
ARLMWLRGPFDY

SEQ ID NO: 5060 - protein, 111 aa, Artificial Sequence
  Synthetic
NFVLTQPHSVSESPGKTVTISCTGSSGSIASNYVQWYQQRPGSAPTTVIYEDNQRPSGVPDRFSGSIDDSSNSASLTISGLKTEDEADYYCQSYDSSTHVVFGGGTKLTVL

SEQ ID NO: 5061 - protein, 10 aa, Artificial Sequence
  Synthetic
QSYDSSTHVV

SEQ ID NO: 5062 - protein, 123 aa, Artificial Sequence
  Synthetic
QVQLVQSGAEVRKPGASVKVSCKASGYTFTNYYLHWVRHAPGQGLEWMGIINPSGGSTTYAQKFQGRVTLTTDTSTSTVYMELSSLRSEDTAVYYCARDSAFIPHIEYGMDVWGQGTTVTVSS

SEQ ID NO: 5063 - protein, 16 aa, Artificial Sequence
  Synthetic
ARDSAFIPHIEYGMDV

SEQ ID NO: 5064 - protein, 109 aa, Artificial Sequence
  Synthetic
QSVLTQPPSASGSPGQSVTISCTGTSDVGGYNYVSWYQQHPGKAPKVMIYEVTKRPSGVPDRFSGSKSGNTASLTVSGLQAEDEADYYCSSYAGSNNLLFGGGTKLTVL

SEQ ID NO: 5065 - protein, 10 aa, Artificial Sequence
  Synthetic
SSYAGSNNLL

SEQ ID NO: 5066 - protein, 128 aa, Artificial Sequence
  Synthetic
QVQLQESGPGLVKPSGTLSLTCAVSGGSISSSNWWSWVRQPPGKGLEWIGEIYHTGSTNYNPSLNSRVTISVDKSKNLFSLKLTSVTAADTAVYYCARVPHSPTVTLPTRFAYGMDVWGQGTTVTVSS

SEQ ID NO: 5067 - protein, 21 aa, Artificial Sequence
  Synthetic
ARVPHSPTVTLPTRFAYGMDV

SEQ ID NO: 5068 - protein, 110 aa, Artificial Sequence
  Synthetic
QSVLTQPPSASGTPGQRVTISCSGSTSNIGSSFVYWYQQLPGTAPKLLIYRNNQRPSGVPDRFSGSSSGTSASLAISGLRSEDEADFYCAAWDDSLGGWLFGGGTKLTVL

SEQ ID NO: 5069 - protein, 11 aa, Artificial Sequence
  Synthetic
AAWDDSLGGWL

SEQ ID NO: 5070 - protein, 120 aa, Artificial Sequence
  Synthetic
QLQLQESGPGLVKPSETLSLTCIVSGGSISSSRHYWGWIRQPPGKGLEWIGIMYYSGITYYNPSLKSRVTISVDTSKNHFSLKLSSVTAADTAVYYCARLRWLRGDFDSWGPGTLVTVSS

SEQ ID NO: 5071 - protein, 12 aa, Artificial Sequence
  Synthetic
ARLRWLRGDFDS

SEQ ID NO: 5072 - protein, 109 aa, Artificial Sequence
  Synthetic
NFMLTQPHSVSESPGKTLTISCTASSGSIASNYVQWYQQRPGSAPTTVIYEDNQRPSGVPDRFSGSIDSSSNSASLTISGLKTEDEADYYCQSYDSSTHVFGTGTKVTV

SEQ ID NO: 5073 - protein, 9 aa, Artificial Sequence
  Synthetic
QSYDSSTHV

SEQ ID NO: 5074 - protein, 126 aa, Artificial Sequence
  Synthetic
QVQLVQSGAEVKKPGASVKVSCKASGYTLTSYGISWVRQAPGQGLEWMGWISAYNGNTNYAQKLQGRVTMTTDTSTSTAYMELRSLRSDDTAVYYCARDLRTYIGESYYYYGMDVWGRGTTVTVSS

SEQ ID NO: 5075 - protein, 19 aa, Artificial Sequence
  Synthetic
ARDLRTYIGESYYYYGMDV

SEQ ID NO: 5076 - protein, 108 aa, Artificial Sequence
  Synthetic
SYVLTQPPSVSVAPGQTARITCGGNNVGSKSVHWYQQRPGQAPVLVIFYDSDRPSGIPERFSGSNSGNTATLTISRVEAGDEADYFCQVWDSTSDHYVFGTGTKVTVL

SEQ ID NO: 5077 - protein, 11 aa, Artificial Sequence
  Synthetic
QVWDSTSDHYV

SEQ ID NO: 5078 - protein, 129 aa, Artificial Sequence; identical to SEQ ID NO: 4982
  Synthetic

SEQ ID NO: 5079 - protein, 23 aa, Artificial Sequence
  Synthetic
ARETSYYDSSGSFSGSHPYYFDS

SEQ ID NO: 5080 - protein, 111 aa, Artificial Sequence
  Synthetic
QSVLTQPPSVSGAPGQRVTISCTGRSSNIGAGYDVHWYQQLPGTAPKLLIYGNNNRPSGVPDRFSGSKSGTSASLAITGLQAEDEADYYCQSYDSSLTGWVFGGGTKLTVL

SEQ ID NO: 5081 - protein, 11 aa, Artificial Sequence
  Synthetic
QSYDSSLTGWV

SEQ ID NO: 5082 - protein, 121 aa, Artificial Sequence
  Synthetic
QLQLQESGPGLVKPSETLSLTCTVSGGSISRSSYYWGWIRQPPGKGLEWIGSMYYSGSTYYNPSLKSRVTISVDTSKNQFSLKLSSVTAADTAVYYCARSLLRWNGAFDIWGQGTMVTVSS

SEQ ID NO: 5083 - protein, 13 aa, Artificial Sequence
  Synthetic
ARSLLRWNGAFDI

SEQ ID NO: 5084 - protein, 109 aa, Artificial Sequence
  Synthetic
SYVLTQPPSVSVAPGKTARITCGVNNIGSYSVHWYQQNPGQAPVLVIYYDSDRPSGIPERFSGSNSGNTATLTISRVEAGDEADYYCQVWDNSSDHPYVFGTGTKVTVL

SEQ ID NO: 5085 - protein, 12 aa, Artificial Sequence
  Synthetic
QVWDNSSDHPYV

SEQ ID NO: 5086 - protein, 120 aa, Artificial Sequence
  Synthetic
EVQLVESGGGLVQPGRSLRLSCAASGFTFDDYAMHWVRQAPGKALEWVSGISWNSGSIAYADSVRGRFTISRDNAKNSLYLQMNSLRAEDTALYYCAKDQGNYGDYFDYWGQGTLVTVSS

SEQ ID NO: 5087 - protein, 13 aa, Artificial Sequence
  Synthetic
AKDQGNYGDYFDY

SEQ ID NO: 5088 - protein, 114 aa, Artificial Sequence
  Synthetic
SYVLTQPPSVSVAPGKTARITCGGNNIGSKSVHWYQQKPGQAPVLVIYYDSDRPSGIPERFSGSNSGNTATLTISRVEAGDEADYYCQVWDSTSDHYVFGDHYVFGTGTKVTVL

SEQ ID NO: 5089 - protein, 17 aa, Artificial Sequence
  Synthetic
QVWDSTSDHYVFGDHYV

SEQ ID NO: 5090 - protein, 128 aa, Artificial Sequence
  Synthetic
EVQLLESGGGLVQPGGSLRLSCEASGFTFSSYAMTWVRQAPGKGLEWVSAISGSGGSTYYADSVKGRFTISRDNSKNTLYLQMNSLRAEDTAVYYCAKEISEEQQLDDYYYYYGMDVWGQGTTVTVSS

SEQ ID NO: 5091 - protein, 21 aa, Artificial Sequence
  Synthetic
AKEISEEQQLDDYYYYYGMDV

SEQ ID NO: 5092 - protein, 107 aa, Artificial Sequence
  Synthetic
SYVLTQPPSVSVSPGQTASITCSGDKLGDKYACWYQQKPGQSPVLVIYQDSKRPSGIPERFSGSNSGNTATLTISGTQAMDEADYYCQAWDSRNAWVFGGGTKLTVL

SEQ ID NO: 5093 - protein, 10 aa, Artificial Sequence
  Synthetic
QAWDSRNAWV

SEQ ID NO: 5094 - protein, 123 aa, Artificial Sequence
  Synthetic
QVQLVESGGGVVQPGRSLRLSCAASGFTFSRYAMHWVRQAPGKGLEWVAVIWYDGSNKYYADSVKGRFTISRDNSKNTLYLQMNSLRTEDTAVYYCAKTLYSYAYDQYYFDYWGQGTLVTVSS

SEQ ID NO: 5095 - protein, 16 aa, Artificial Sequence
  Synthetic
AKTLYSYAYDQYYFDY

SEQ ID NO: 5096 - protein, 108 aa, Artificial Sequence
  Synthetic
AIQLTQSPSSLSASVGDRVTITCRASQGISSALAWYQQKPGKAPKLLISDASSLESGVPSRFSGSGSGTDFSLTISSLQPEDFATYYCQQFNSYPPLTFGGGTKVEIK

SEQ ID NO: 5097 - protein, 10 aa, Artificial Sequence
  Synthetic
QQFNSYPPLT

SEQ ID NO: 5098 - protein, 124 aa, Artificial Sequence
  Synthetic
QVQLVESGGGVVQPGRSLRLSCAASGFTFSSYAMHWVRQAPGKGLEWVAIISYDGSNKYYADSVKGRFTISRDNSKNTLYLEMNSLRAEDTAVYYCAREKQWLLQGYYYYMNVWGKGTTVTVSS

SEQ ID NO: 5099 - protein, 17 aa, Artificial Sequence
  Synthetic
AREKQWLLQGYYYYMNV

SEQ ID NO: 5100 - protein, 107 aa, Artificial Sequence
  Synthetic
EIVLTQSPATLSLSPGERATLSCRASQSVSSYLAWYQQKPGQAPRLLIYDASNRATGIPASFSGSGSGTDFTLTISSLEPEDFAVYYCQQRSNWPITFGQGTRLEIK

SEQ ID NO: 5101 - protein, 9 aa, Artificial Sequence
  Synthetic
QQRSNWPIT

SEQ ID NO: 5102 - protein, 123 aa, Artificial Sequence
  Synthetic
QVQLVESGGGVVQPGRSLRLSCAASGFTFSNYGMHWVRQAPGKGLEWVTFISYDGSNKYYADSVKGRFTISRDNSKNTLYLQMNSLRAEDTAVYYCAKTVYSYAYDQYYFDYWGQGTLVTVSS

SEQ ID NO: 5103 - protein, 16 aa, Artificial Sequence
  Synthetic
AKTVYSYAYDQYYFDY

SEQ ID NO: 5104 - protein, 108 aa, Artificial Sequence
  Synthetic
AIQLTQSPSSLSASVGDRVTITCRASQGISSALAWYQQKAGKAPKLLIYDASSLESGVPSRFSGSGSGTDFTLTISSLQPEDFATYYCQQFNTYPPLTFGGGTKVEIK

SEQ ID NO: 5105 - protein, 10 aa, Artificial Sequence
  Synthetic
QQFNTYPPLT

SEQ ID NO: 5106 - protein, 120 aa, Artificial Sequence
  Synthetic
QVQLVESGGGVVQPGRSLRLSCAASGFTFSSYAMHWVRQAPGKGLEWVAVILYDGSYKDYADSVKGRISISRDNSKNTLFLQMNSLRAEDTAVYYCARDWGSTVTLFDSWGQGTLVTVSS

SEQ ID NO: 5107 - protein, 13 aa, Artificial Sequence
  Synthetic
ARDWGSTVTLFDS

SEQ ID NO: 5108 - protein, 108 aa, Artificial Sequence
  Synthetic
DIQMTQSPSSLSASVGDRITITCRASQSISSYLNWYQQKPGKAPKLLIYAASSLQSGVPSRFSGSGSGTDFTLTISSLQPEDFATYYCQQSYNTPPWTFGQGTKVEIK

SEQ ID NO: 5109 - protein, 10 aa, Artificial Sequence
  Synthetic
QQSYNTPPWT

SEQ ID NO: 5110 - protein, 127 aa, Artificial Sequence
  Synthetic
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGGGVYCSGGNCYSHYFDYWGQGTLVTVSS

SEQ ID NO: 5111 - protein, 20 aa, Artificial Sequence
  Synthetic
AKGGGVYCSGGNCYSHYFDY

SEQ ID NO: 5112 - protein, 106 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNIQGTFGQGTKLEIK

SEQ ID NO: 5113 - protein, 8 aa, Artificial Sequence
  Synthetic
QQYNIQGT

SEQ ID NO: 5114 - protein, 121 aa, Artificial Sequence
  Synthetic
EVQLVESGGGLAQPGRSLRLSCAASGFKFDDYAMHWVRQAPGQGLEWVSGIDWNSGIIGYADSVMGRFTISRDNAKKSLYLQMNSLRAEDTGLYYCAKSGGFGEFKWFDPWGQGTLVTVSS

SEQ ID NO: 5115 - protein, 14 aa, Artificial Sequence
  Synthetic
AKSGGFGEFKWFDP

SEQ ID NO: 5116 - protein, 107 aa, Artificial Sequence
  Synthetic
EIVMTQSPATLSVSPGERATLSCRASQSVSSNLAWYQQKPGQAPRLLIYGASTRATGFPARFSGSGSGTEFTLTISRLQSEDFAVYYCQQYNKWPRTFGQGTRLEIK

SEQ ID NO: 5117 - protein, 9 aa, Artificial Sequence
  Synthetic
QQYNKWPRT

SEQ ID NO: 5118 - protein, 118 aa, Artificial Sequence
  Synthetic
EVQLVQSGAEVKKPGESLKISCKGSGYRFSSYWIGWVRQMPGKGLEWMGIIYPGDSDTRYSPSFQGQVTISADKSISTAYLQWSSLRASDTAMYYCARSRSSDYLDYWGQGTLVTVSS

SEQ ID NO: 5119 - protein, 11 aa, Artificial Sequence
  Synthetic
ARSRSSDYLDY

SEQ ID NO: 5120 - protein, 107 aa, Artificial Sequence
  Synthetic
AIQLTQSPSSLSASVGDRVTITCRASQGISSGLAWYQQKPGKAPKVLIYDASSLESGVPSRFSGSGSGTDFTLTISSLQPEDFATYYCQQFNSYPRTFGQGTKVEIK

SEQ ID NO: 5121 - protein, 9 aa, Artificial Sequence
  Synthetic
QQFNSYPRT

SEQ ID NO: 5122 - protein, 128 aa, Artificial Sequence
  Synthetic
EVQLVESGGGLVQPGGSLRLSCAASGFTFSNYDMHWVRQGTGKGLEWVSVIGTAGDTYYPGSVKGRFTISRENAKNSLYLQMDSLRAGDTAVYYCARASQVTVTSRLRYYYYYTLDVWGQGTTVTVSS

SEQ ID NO: 5123 - protein, 22 aa, Artificial Sequence
  Synthetic
ARASQVTVTSRLRYYYYYTLDV

SEQ ID NO: 5124 - protein, 108 aa, Artificial Sequence
  Synthetic
DIQMTQSPSSLSASVGDRVTITCRAGQSISSYLNWYQQKPGKAPKLLIYAASSLQSGVPLRFSGSGSGTDFTLTISSLQPEDFATYYCQQSYITTGFTFGPGTKVDIK

SEQ ID NO: 5125 - protein, 10 aa, Artificial Sequence
  Synthetic
QQSYITTGFT

SEQ ID NO: 5126 - protein, 127 aa, Artificial Sequence
  Synthetic
QVQLVESGGGVVQPGRSLRLSCAASGFTFSTYAMHWVRQAPGKGLEWVAVISYDGSNRYYADSVKGRFTISRDNSKNTLYLQMNSLRAEDTAVYYCARDGRTITMVQGVISGAFDIWGQGTMVTVSS

SEQ ID NO: 5127 - protein, 20 aa, Artificial Sequence
  Synthetic
ARDGRTITMVQGVISGAFDI

SEQ ID NO: 5128 - protein, 107 aa, Artificial Sequence
  Synthetic
DIQMTQSPSSLSASVGDRVTITCQASQDISNYLNWFQQKPGKAPKLLIYDASNLETGVPSRFSGSGSGAHFTFTISSLQPEDIATYYCQQYDNLPFTFGPGTKVDIK

SEQ ID NO: 5129 - protein, 9 aa, Artificial Sequence
  Synthetic
QQYDNLPFT

SEQ ID NO: 5130 - protein, 132 aa, Artificial Sequence
  Synthetic
EVQLVESGGGLVKPGGSLRLSCAASGFTFTNAWMSWVRQAPGKGLEWVGRIKSKTDGGTTDYAAPVKGRFTISRDDSKNTLYLQMNSLKTEDTAVYYCTTVADYDFWSGYYGGYYYYYMDVWGNGTTVTVSS

SEQ ID NO: 5131 - protein, 23 aa, Artificial Sequence
  Synthetic
TTVADYDFWSGYYGGYYYYYMDV

SEQ ID NO: 5132 - protein, 112 aa, Artificial Sequence
  Synthetic
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQTIQLPITFGQGTRLEIK

SEQ ID NO: 5133 - protein, 9 aa, Artificial Sequence
  Synthetic
MQTIQLPIT

SEQ ID NO: 5134 - protein, 124 aa, Artificial Sequence
  Synthetic
EVQLVESGGGLVQPGRSLRLSCAASGFTFDDYAMHWVRQAPGKGLEWVSGISWNGGTLGYADSVKGRFIISRDNAKNSLYLQMNSLRPEDTALYYCAKDLRYLDNGGDYYMDVWGTGTTVTVSS

SEQ ID NO: 5135 - protein, 17 aa, Artificial Sequence
  Synthetic
AKDLRYLDNGGDYYMDV

SEQ ID NO: 5136 - protein, 107 aa, Artificial Sequence
  Synthetic
DIQMTQSPSSVSASVGDRVTITCRASQGISGWLAWYQQRPGKAPKLLIYAASSLQSGVPSRFSGSGSGTDFTLTITSLQPEDFATYYCQQANSFPITFGQGTRLEIK

SEQ ID NO: 5137 - protein, 9 aa, Artificial Sequence
  Synthetic
QQANSFPIT

SEQ ID NO: 5138 - protein, 122 aa, Artificial Sequence
  Synthetic
EVQLVESGGGLVQPGRSLRLSCAASGFTFDDYAMHWVRQAPGKGLEWVSGISWNSGTIGYADSVKGRFTIVRDNAKNSLYLQMIRLRAEDTALYYCAKDRGYGDYEEGILDWGQGTLVTVSS

SEQ ID NO: 5139 - protein, 15 aa, Artificial Sequence
  Synthetic
AKDRGYGDYEEGILD

SEQ ID NO: 5140 - protein, 108 aa, Artificial Sequence
  Synthetic
EIVLTQSPGTLSLSPGERATLSCRASQSVSSSYLAWYQHKPGQAPRLLIYGASSRATGIPDRFSGSGSGTDFTLTISRLEPEDFAMYYCQQYGSSPYTFGQGTKLEIK

SEQ ID NO: 5141 - protein, 9 aa, Artificial Sequence
  Synthetic
QQYGSSPYT

SEQ ID NO: 5142 - protein, 126 aa, Artificial Sequence
  Synthetic
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCVSQNVHSGRTYYYFYYMDVWGKGTTVTVSS

SEQ ID NO: 5143 - protein, 19 aa, Artificial Sequence
  Synthetic
VSQNVHSGRTYYYFYYMDV

SEQ ID NO: 5144 - protein, 107 aa, Artificial Sequence
  Synthetic
DIQMTQSPSSLSASVGDRVTITCRARQSISSYLNWYQQKPGKAPKLLIYAASSLQSGVPSRFSGSGSGTDFTLTISSLQPEDFATYYCQQSYSTLWTFGPGTKVDIK

SEQ ID NO: 5145 - protein, 9 aa, Artificial Sequence
  Synthetic
QQSYSTLWT

SEQ ID NO: 5146 - protein, 121 aa, Artificial Sequence
  Synthetic
EVQLVESGGGLVQPGGSLRLSCAASGFTFSSYDMHWVRQTTGKSLEWVSTIGTAGDTYYPGSVKGRFTISRENAKNSLYLQMNSLRAGDTAVYYCARVEYSSDIYWYFDLWGRGTLVTVSS

SEQ ID NO: 5147 - protein, 15 aa, Artificial Sequence
  Synthetic
ARVEYSSDIYWYFDL

SEQ ID NO: 5148 - protein, 108 aa, Artificial Sequence
  Synthetic
DIQMTQSPSSLSASVGDRVTMTCRASQSIGRYLNWYQQKPGKAPKLLIYVASSLQSGVPSRFSGSGSGTDFTLTISSLQPEDFATYYCQQSYTNPQYTFGQGTKLEIK

SEQ ID NO: 5149 - protein, 10 aa, Artificial Sequence
  Synthetic
QQSYTNPQYT

SEQ ID NO: 5150 - protein, 121 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGDYGDGYYYYGMDVWGQGTTVTVSS

SEQ ID NO: 5151 - protein, 15 aa, Artificial Sequence
  Synthetic
AGDYGDGYYYYGMDV

SEQ ID NO: 5152 - protein, 107 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIK

SEQ ID NO: 5153 - protein, 9 aa, Artificial Sequence
  Synthetic
QQRSNWPLT

SEQ ID NO: 5154 - protein, 124 aa, Artificial Sequence
  Synthetic
EVQLVESGGGMVQPGRSLRLSCAASGFTFDEYAMHWVRQAPGKGLEWVSGISWNGGTIGYADSVKGRFTISRDNSKNSLYLQMNSLRGEDTALYYCAKDIYPLDYGDAFFFDSWGQGTLVTVSS

SEQ ID NO: 5155 - protein, 17 aa, Artificial Sequence
  Synthetic
AKDIYPLDYGDAFFFDS

SEQ ID NO: 5156 - protein, 109 aa, Artificial Sequence
  Synthetic
EIVLTQSPGTLSLSPGERATLSCRASQSVSSSYLAWYQQKPGQAPRLLFYAASSRATGIPDRFSGSGSGTDFTLTISRLEPEDFAVYYCQHYGGSPPITFGPGTKVDIK

SEQ ID NO: 5157 - protein, 10 aa, Artificial Sequence
  Synthetic
QHYGGSPPIT

SEQ ID NO: 5158 - protein, 125 aa, Artificial Sequence
  Synthetic
QVQLVQSGAEVKKPGSSVKVSCKASGGSIRTYSISWVRQAPGQGLEWMGRIINIVDIANYAQKFQGRVSITADKSTNTAYMELSSLRSEDTAVYYCATLSSSHSDASGTIWFDPWGQGTLVTVSS

SEQ ID NO: 5159 - protein, 18 aa, Artificial Sequence
  Synthetic
ATLSSSHSDASGTIWFDP

SEQ ID NO: 5160 - protein, 107 aa, Artificial Sequence
  Synthetic
EIVMTQSPATLSLSPGERATLSCRASQSISSNYLSWYQQKPGQTPRLLIYGASTRATGIPARFSGSGSGTHFTLTISSLQPEDFAVYYCHQDYDLHTFGGGTKVEIK

SEQ ID NO: 5161 - protein, 8 aa, Artificial Sequence
  Synthetic
HQDYDLHT

SEQ ID NO: 5162 - protein, 121 aa, Artificial Sequence
  Synthetic
EVQLVESGGGLVQPGGSLRLSCAASGFTFSSYDMHWVRQATGKGLEWVSTIGTDGDTYYPGSVKGRFTISRENAKNSLYLQMNSLRAGDTAVYYCARVEYSSGIYWYFDLWGRGTLVTVSS

SEQ ID NO: 5163 - protein, 15 aa, Artificial Sequence
  Synthetic
ARVEYSSGIYWYFDL

SEQ ID NO: 5164 - protein, 108 aa, Artificial Sequence
  Synthetic
DIQMTQSPSSLSASIGDRVTITCRASQRISRYLNWYQQKPGKAPKLLIYTASSLQSGVPSRFSGSGSGTDFTLTISSLQPEDFATYYCQQSYSNPQYTFGQGTKLEIK

SEQ ID NO: 5165 - protein, 10 aa, Artificial Sequence
  Synthetic
QQSYSNPQYT

SEQ ID NO: 5166 - protein, 121 aa, Artificial Sequence
  Synthetic
EVQLVESGGGLLQPGGSLRLSCAASGFTFSNYDMHWVRQATGKGLEWVSTIGTAGDTYYPGSVKGRFTISRENAKNSLYLQMTSLTAGDTAVYYCARVEYSSGIYWYFDLWGRGTLVTVSS

SEQ ID NO: 5167 - protein, 15 aa, Artificial Sequence
  Synthetic
ARVEYSSGIYWYFDL

SEQ ID NO: 5168 - protein, 107 aa, Artificial Sequence
  Synthetic
DIQMTQSPSSLSASVGDRVTITCRASQSISGYLNWYQQKPGKSPKLLIYAASSLQSGVPSRFSGSGSGTDFTLTISSLQPEDFATYYCQQSYTNPHYTFGQGTKLDI

SEQ ID NO: 5169 - protein, 10 aa, Artificial Sequence
  Synthetic
QQSYTNPHYT

SEQ ID NO: 5170 - protein, 124 aa, Artificial Sequence
  Synthetic
EVQLVESGGGLVQPGRSLRLSCSVSGFTFDEYAMHWVRQAPGKGLEWVSGISWNGGTIGYADSVKGRFTISRDNAKNSLYLQMNSLRAADTALYYCAKDIYPLDYGDAFFFDSWGQGTLVTVSS

SEQ ID NO: 5171 - protein, 17 aa, Artificial Sequence
  Synthetic
AKDIYPLDYGDAFFFDS

SEQ ID NO: 5172 - protein, 109 aa, Artificial Sequence
  Synthetic
EIVLTQSPGTLSLSPGERVTLSCRASQRVSSSYLAWYQQKPGQAPRLLIYGASSRAIGIPDRFSGGGSGTDFTLTISRLEPEDFAVYYCQCYGSTPPITFGPGTKVDIK

SEQ ID NO: 5173 - protein, 10 aa, Artificial Sequence
  Synthetic
QCYGSTPPIT

SEQ ID NO: 5174 - protein, 117 aa, Artificial Sequence
  Synthetic
EVQLVESGGDLVQPGGSLRLSCAASGLTVSSNYMNWVRQAPGKGLEWVSVIYSGGSTFYADSVKGRFTISRHNSKNTLYLQMNSLRAEDTAVYYCARDLYYYGMDVWGQGTTVTVSS

SEQ ID NO: 5175 - protein, 11 aa, Artificial Sequence
  Synthetic
ARDLYYYGMDV

SEQ ID NO: 5176 - protein, 106 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQINSYPLFGQGTKLEIK

SEQ ID NO: 5177 - protein, 8 aa, Artificial Sequence
  Synthetic
QQINSYPL

SEQ ID NO: 5178 - protein, 124 aa, Artificial Sequence; identical to SEQ ID NO: 5134
  Synthetic

SEQ ID NO: 5179 - protein, 17 aa, Artificial Sequence
  Synthetic
AKDLRYLDNGGDYYMDV

SEQ ID NO: 5180 - protein, 107 aa, Artificial Sequence; identical to SEQ ID NO: 5136
  Synthetic

SEQ ID NO: 5181 - protein, 9 aa, Artificial Sequence
  Synthetic
QQANSFPIT

SEQ ID NO: 5182 - protein, 124 aa, Artificial Sequence
  Synthetic
EVQLVESGGGLVQPGRSLRLSCSASGFTFDEYAMHWVRQAPGKGLEWVSGISWNGGIIGYADSVKGRFTISRDNAKNSLYLQMNSLRAADTALYYCAKDIYPLDYGDAFFFDCWGQGTLVTVSS

SEQ ID NO: 5183 - protein, 17 aa, Artificial Sequence
  Synthetic
AKDIYPLDYGDAFFFDC

SEQ ID NO: 5184 - protein, 109 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQCYGSTPPITFGPGTKVDIK

SEQ ID NO: 5185 - protein, 10 aa, Artificial Sequence
  Synthetic
QCYGSTPPIT

SEQ ID NO: 5186 - protein, 119 aa, Artificial Sequence
  Synthetic
EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDYGAYGRRNDFWGQGTLVTVSS

SEQ ID NO: 5187 - protein, 13 aa, Artificial Sequence
  Synthetic
ARDYGAYGRRNDF

SEQ ID NO: 5188 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPRTFGQGTKLEIK

SEQ ID NO: 5189 - protein, 9 aa, Artificial Sequence
  Synthetic
QQYDNLPRT

SEQ ID NO: 5190 - protein, 124 aa, Artificial Sequence
  Synthetic
EVQLVESGGGLVQPGRSLRLSCAASGFTFDDYAMHWVRQAPGKGLEWVSGISWNGGTLGYADSVKGRFTISRDNAKKSLFLQLNRLRAEDTALYYCAKDIYPLDYADAFFFDYWGQGTLVSVSS

SEQ ID NO: 5191 - protein, 17 aa, Artificial Sequence
  Synthetic
AKDIYPLDYADAFFFDY

SEQ ID NO: 5192 - protein, 109 aa, Artificial Sequence
  Synthetic
EIVLTQSPGTLSLSPGEGATLSCRASQSVRSSSLGWYQHKPGQAPRLLIYGASTRATGIPDRFSGSGSGTDFTLTISRLEPEDFVVYYCQLYGSSPPITFGPGTKVDVK

SEQ ID NO: 5193 - protein, 10 aa, Artificial Sequence
  Synthetic
QLYGSSPPIT

SEQ ID NO: 5194 - protein, 119 aa, Artificial Sequence
  Synthetic
QVQLQESGPGLVKPSQTLSLTCTVSGGSISGGGYYWTWIRQHPGKGLEWIGHIYYSENTYYNPSLKSRVSISVDTSKNQFSLKLSSVTAADTAVYYCASGRWLPEFDYWGQGTLVTVSS

SEQ ID NO: 5195 - protein, 11 aa, Artificial Sequence
  Synthetic
ASGRWLPEFDY

SEQ ID NO: 5196 - protein, 109 aa, Artificial Sequence
  Synthetic
EIVMTQSPVSLSVSPGERATLSCRASQSVSSNLAWYQQKPGQAPRLLIYGASTRATGIPARFSGSGSGTEFTLTISSLQSEDFAVYYCQQYNNWPRGFTFGPGTNVDIK

SEQ ID NO: 5197 - protein, 11 aa, Artificial Sequence
  Synthetic
QQYNNWPRGFT

SEQ ID NO: 5198 - protein, 114 aa, Artificial Sequence
  Synthetic
EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDLRDEVWGQGTTVTVSS

SEQ ID NO: 5199 - protein, 8 aa, Artificial Sequence
  Synthetic
ARDLRDEV

SEQ ID NO: 5200 - protein, 107 aa, Artificial Sequence; identical to SEQ ID NO: 2964
  Synthetic

SEQ ID NO: 5201 - protein, 9 aa, Artificial Sequence
  Synthetic
QQYDNLPRT

SEQ ID NO: 5202 - protein, 122 aa, Artificial Sequence
  Synthetic
EVQLVESGGGLVQPGGSLRLSCEASGFTFSNYDMHWVRQSTVKGLEWVSVIGTAGDTYYPDSVKGRFTISRENAKNSLYLQMNSLRAGDTAVYYCARGNFDSSGYYSNFDYWGQGTLVTVSS

SEQ ID NO: 5203 - protein, 16 aa, Artificial Sequence
  Synthetic
ARGNFDSSGYYSNFDY

SEQ ID NO: 5204 - protein, 108 aa, Artificial Sequence
  Synthetic
DIQMTQSPSSLSASVGDRVTITCRASQSIRSYLNWYQQKPGKAPKLLIYAASSLQSGVPSRFSGSGSGTDFTLTISSLQPEDFATYYCQQSYSIPPLTFGGGTKVEIK

SEQ ID NO: 5205 - protein, 10 aa, Artificial Sequence
  Synthetic
QQSYSIPPLT

SEQ ID NO: 5206 - protein, 132 aa, Artificial Sequence
  Synthetic
QVQLVQSGAEVKKPGASVRVSCKASGYTFTSYGISWVRQAPGQGLEWMGWVSPYNGNTYYAQEFQGRVTMTTDTSTSTAYMELGSLRSDDTAVYYCARVKSNSGPQLRFLEWLLFDYYMDVWGKGTTVTVSS

SEQ ID NO: 5207 - protein, 25 aa, Artificial Sequence
  Synthetic
ARVKSNSGPQLRFLEWLLFDYYMDV

SEQ ID NO: 5208 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSFSTPRTFGPGTKVDIK

SEQ ID NO: 5209 - protein, 9 aa, Artificial Sequence
  Synthetic
QQSFSTPRT

SEQ ID NO: 5210 - protein, 123 aa, Artificial Sequence
  Synthetic
QVQLQESGPGLVKPSGTLSLTCAVSGGSITSSNWWSWVRQPPGKGLEWIGEIYHRGYTNYNPSLKTRVTLSIDKSKNQFSLKLNTVTAADTAVYYCARAFQDGTSGPYYFDSWGQGTLVTVSS

SEQ ID NO: 5211 - protein, 16 aa, Artificial Sequence
  Synthetic
ARAFQDGTSGPYYFDS

SEQ ID NO: 5212 - protein, 106 aa, Artificial Sequence
  Synthetic
EIVMTQSPSLSVSPGERATLSCRASQSVSSNLAWYQQKPGQAPRLLIYGASTRATGIPARFSGSGSGTEFTLTISSLQSEDFAVYYCQQYNNWPGTFGQGTKVEIK

SEQ ID NO: 5213 - protein, 9 aa, Artificial Sequence
  Synthetic
QQYNNWPGT

SEQ ID NO: 5214 - protein, 127 aa, Artificial Sequence
  Synthetic
QVQLVESGGGVVQPGRSLRLSCAASGFTFSHYGMHWVRQAPGKGLEWVAVILYDGSDKYYADSVKGRFTISRDNPKNTLYLQMNSLRAEDTAVYYCAKQAGPYCSGGNCYGGTLDYWGQGSLVTVSS

SEQ ID NO: 5215 - protein, 20 aa, Artificial Sequence
  Synthetic
AKQAGPYCSGGNCYGGTLDY

SEQ ID NO: 5216 - protein, 107 aa, Artificial Sequence
  Synthetic
DIQMTQSPSSLSASVGDRVTITCQASQDISNYLNWYQQKPGQAPKLLIYDASNLETGVPSRFSGSGSGTDFTFTISSLQPDDIATYYCQQYDNLPPAFGPGTKVDIK

SEQ ID NO: 5217 - protein, 9 aa, Artificial Sequence
  Synthetic
QQYDNLPPA

SEQ ID NO: 5218 - protein, 125 aa, Artificial Sequence
  Synthetic
EVQLVESGGGLVQPGRSLRLSCAASGFTFDDYAMHWVRQAPGKGLEWVAGISWHSGSISYADSEKGRFTISRDNAKNSLYLQMNSLRAEDTALYYCAKDIVARLGVVTNYGMDVWGQGTTVIVSS

SEQ ID NO: 5219 - protein, 18 aa, Artificial Sequence
  Synthetic
AKDIVARLGVVTNYGMDV

SEQ ID NO: 5220 - protein, 107 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPADFAVYYCQQRSNWPLTFGGGTKVEIK

SEQ ID NO: 5221 - protein, 9 aa, Artificial Sequence
  Synthetic
QQRSNWPLT

SEQ ID NO: 5222 - protein, 120 aa, Artificial Sequence
  Synthetic
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCAREGVTAIGQAFDIWGQGTMVTVSS

SEQ ID NO: 5223 - protein, 14 aa, Artificial Sequence
  Synthetic
AREGVTAIGQAFDI

SEQ ID NO: 5224 - protein, 108 aa, Artificial Sequence
  Synthetic
DIQMTQSPSSLSASVGDRVTITCQASQDISNYLNWYQQKPGKAPKLLIYDASNLETGVPSRFSGSGSGTDFTVTISSLQPEDIATYYCQQYDNLPSFTFGPGTKVDIK

SEQ ID NO: 5225 - protein, 10 aa, Artificial Sequence
  Synthetic
QQYDNLPSFT

SEQ ID NO: 5226 - protein, 114 aa, Artificial Sequence
  Synthetic
EVQLVESGGGLVQPGGSLRLSCAASGFTLSTNYISWVRQAPGKGLEWVSVTYSGGSTYYADSVKGRFTVSRDNSKNTLYLQMNSLRAEDTAVYYCAGYDYTFLWGQGTLVTVSS

SEQ ID NO: 5227 - protein, 8 aa, Artificial Sequence
  Synthetic
AGYDYTFL

SEQ ID NO: 5228 - protein, 107 aa, Artificial Sequence
  Synthetic
DIQMTQSPSTLSASVGDRVTITCRASQSISSWLAWYQQKPGKAPKLLIYKASTLESGVPSRFSGSGSGTEFTLTISSLQPDDFATYFCHHYISYPWTFGQGTKVEIK

SEQ ID NO: 5229 - protein, 9 aa, Artificial Sequence
  Synthetic
HHYISYPWT

SEQ ID NO: 5230 - protein, 121 aa, Artificial Sequence
  Synthetic
QVQLVESGGGVVQPGRSLRLSCAASGFTFSSYGMNWVRQAPGKGLEWVALISYDGSNKYYADSVKGRFTISRDNSKNTLYLQMNSLRAEDTAVYYCAKGGLYSSSSLDDYWGQGTLVTVSS

SEQ ID NO: 5231 - protein, 14 aa, Artificial Sequence
  Synthetic
AKGGLYSSSSLDDY

SEQ ID NO: 5232 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLLLTFGGGTKVEIK

SEQ ID NO: 5233 - protein, 9 aa, Artificial Sequence
  Synthetic
QQYDNLLLT

SEQ ID NO: 5234 - protein, 123 aa, Artificial Sequence
  Synthetic
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARAYQDGTSGPYYFDYWGQGTLVTVSS

SEQ ID NO: 5235 - protein, 16 aa, Artificial Sequence
  Synthetic
ARAYQDGTSGPYYFDY

SEQ ID NO: 5236 - protein, 105 aa, Artificial Sequence
  Synthetic
EIVMTQSPLSVSPGERATLSCRASQSVSSNLAWYQQKPGQAPRLLIYGASTRATGIPARFSGSGSGTEFTLTISSLQSEDFAVYYCQQYNNWPGTFGQGTKVEIK

SEQ ID NO: 5237 - protein, 9 aa, Artificial Sequence
  Synthetic
QQYNNWPGT

SEQ ID NO: 5238 - protein, 124 aa, Artificial Sequence
  Synthetic
EVQLVESGGGLVQPGRSLRLSCAASGFTFDDYAMHWVRQSPGRGLEWVSGLSWNGGTLGYADSVKGRFIISRDNAKNSLYLQMNSLRPEDTALYYCAKDLRFLDNGGDYYMDVWGKGTTVTVSS

SEQ ID NO: 5239 - protein, 17 aa, Artificial Sequence
  Synthetic
AKDLRFLDNGGDYYMDV

SEQ ID NO: 5240 - protein, 107 aa, Artificial Sequence
  Synthetic
DIQMTQSPVSLSASVGDRVTITCRASQGISGWLAWYQQKPGKAPKLLMYAASSLQSGVPSRFSGSGSGTDFTLTISSLQPEDFATYYCQQANSFPLTFGQGTRLEIK

SEQ ID NO: 5241 - protein, 9 aa, Artificial Sequence
  Synthetic
QQANSFPLT

SEQ ID NO: 5242 - protein, 127 aa, Artificial Sequence
  Synthetic
QVQLQQWGAGLMKPSETLSLTCAVYGGSFNVYYWSWIRQPPGKGLEWIGEINHSGSTNYNPSLKSRVTISVDTSKKQFSLGLSSVTAADTAVYYCARGQITMVHGASSPYYYYYLDVWDRGTTVTVS

SEQ ID NO: 5243 - protein, 22 aa, Artificial Sequence
  Synthetic
ARGQITMVHGASSPYYYYYLDV

SEQ ID NO: 5244 - protein, 107 aa, Artificial Sequence
  Synthetic
DIQMTQSPSSLSASVGDRVTITCRASQHINSYLNWYQQKPGKAPKLLIYAASSLQGGVPSRFSGSGSGTDFTLTISSLQPEDFATYYCQQSSSTPRTFGQGTRLEIK

SEQ ID NO: 5245 - protein, 9 aa, Artificial Sequence
  Synthetic
QQSSSTPRT

SEQ ID NO: 5246 - protein, 123 aa, Artificial Sequence
  Synthetic
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARHLGATSYYYYGMDVWGQGTTVTVSS

SEQ ID NO: 5247 - protein, 16 aa, Artificial Sequence
  Synthetic
ARHLGATSYYYYGMDV

SEQ ID NO: 5248 - protein, 106 aa, Artificial Sequence
  Synthetic
DIQMTQSPVLSASVGDRVTITCRASQSISSYLNWYQQKPGKAPKLLIYAASSLQSGVPSRFSGSGSGTDFTLTISSLQPEDFATYYCQQSYSTPPTFGQGTKVEIK

SEQ ID NO: 5249 - protein, 9 aa, Artificial Sequence
  Synthetic
QQSYSTPPT

SEQ ID NO: 5250 - protein, 120 aa, Artificial Sequence
  Synthetic
EVQLVESGGGLVQPGGSLRLSCAASGFTFSSYDMHWVRQPTGKGLECVSAIGTAGDTYYPGSVKGRFTISRENAKNSLYLQMNSLRAGDTAVYYCARGGSSWSNWYFDLWGRGTLVTVSS

SEQ ID NO: 5251 - protein, 14 aa, Artificial Sequence
  Synthetic
ARGGSSWSNWYFDL

SEQ ID NO: 5252 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTINSLQPEDFATYYCQQSYSMPSITFGQGTRLEIK

SEQ ID NO: 5253 - protein, 10 aa, Artificial Sequence
  Synthetic
QQSYSMPSIT

SEQ ID NO: 5254 - protein, 127 aa, Artificial Sequence
  Synthetic
QVQLVESGGGVVQPGRSLRVSCAASGFTFSRYGMHWVRQAPGKGLEWVAVIWYDGSNKYYADSVRGRFTISRDTSKNTLYLQMSSLRAEDTAVYYCARDPFYYDRSGSPRGDAFDIWGQGTMVTVSS

SEQ ID NO: 5255 - protein, 20 aa, Artificial Sequence
  Synthetic
ARDPFYYDRSGSPRGDAFDI

SEQ ID NO: 5256 - protein, 107 aa, Artificial Sequence
  Synthetic
DIQMTQSPSTLAASIGDRVTITCRASQNINNWLAWYQQKPGKAPKLLIQTASGLETGVPSRFSGSGYGTEFTLTISSLQPDDFATYYCHHYNSYSSTFGQGTKLEIK

SEQ ID NO: 5257 - protein, 9 aa, Artificial Sequence
  Synthetic
HHYNSYSST

SEQ ID NO: 5258 - protein, 117 aa, Artificial Sequence
  Synthetic
EVQLVESGGGLVQPGGSLRLSCAASGLIVSSNYMNWVRQAPGKGLEWVSVIYSGGSTFYADSVKGRLTISRHNSKNTLYLQMNSLRPEDTAVYYCARDLDYYGMDVWGQGTTVTVSS

SEQ ID NO: 5259 - protein, 11 aa, Artificial Sequence
  Synthetic
ARDLDYYGMDV

SEQ ID NO: 5260 - protein, 109 aa, Artificial Sequence
  Synthetic
DIQLTQSPSFLSASVGDTVTITCRASQGISSYLAWYQQKPGKAPKLLIYAASTLQSGVPSRFSGSGSGTEFTLTISSLQPEDFATYYCQQLNSYPPAVTFGGGTKVEIK

SEQ ID NO: 5261 - protein, 11 aa, Artificial Sequence
  Synthetic
QQLNSYPPAVT

SEQ ID NO: 5262 - protein, 128 aa, Artificial Sequence
  Synthetic
QVQLVQSGAEVKKPGASVKVSCKASGYTFTTYAMHWVRQAPGQRLEWMGWIYAGDGNTKYSQKFQGRVTITRDTSASTAYMELSSLRSEDTAVYYCARDTSVLYDFWSAYFQNAFDIWGQGTMVTVSS

SEQ ID NO: 5263 - protein, 21 aa, Artificial Sequence
  Synthetic
ARDTSVLYDFWSAYFQNAFDI

SEQ ID NO: 5264 - protein, 107 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSMYTFGQGTKLEIK

SEQ ID NO: 5265 - protein, 8 aa, Artificial Sequence
  Synthetic
QQYGSMYT

SEQ ID NO: 5266 - protein, 127 aa, Artificial Sequence
  Synthetic
QVQLVESGGGVVQPGRSLRLSCAASGFTFRSYGMHWVRQAPGQGLEWLAVISFDGSKRYYADSVKGRFTISRDNSKNTLYLQMNSLRAEDTAVYYCAKDSTPISWIQLWGTDYFDYWGQGTLVTVSS

SEQ ID NO: 5267 - protein, 20 aa, Artificial Sequence
  Synthetic
AKDSTPISWIQLWGTDYFDY

SEQ ID NO: 5268 - protein, 107 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYLFTFGPGTKVDIK

SEQ ID NO: 5269 - protein, 9 aa, Artificial Sequence
  Synthetic
QQYNSYLFT

SEQ ID NO: 5270 - protein, 122 aa, Artificial Sequence
  Synthetic
QVQLVQSGAEVKKPGASVKVSCKASGYTFTNNYMHWVRQAPGQGLEWMGVINPSAGSTSYAQKFQGRVTMTRDTSTSTVYMELSSLRSEDTAVYYCARDLFFVPAAAAFDIWGQGTMVTVSS

SEQ ID NO: 5271 - protein, 15 aa, Artificial Sequence
  Synthetic
ARDLFFVPAAAAFDI

SEQ ID NO: 5272 - protein, 110 aa, Artificial Sequence
  Synthetic
QSVLTQPASVSGSPGQSITISCTGTSSDVGSYNLVSWYQQYPGKAPKLMIYEGSKRPSGVSNRFSGSKSGNTASLTISGLQAEDEADYYCCSYAGSSIWVFGGGTKLTVL

SEQ ID NO: 5273 - protein, 10 aa, Artificial Sequence
  Synthetic
CSYAGSSIWV

SEQ ID NO: 5274 - protein, 126 aa, Artificial Sequence
  Synthetic
EVQLVESGGGLVQPGGSLRLSCAASGFTFSSYAMHWVRQAPGKGLEYVSGIRSNGGSTYYANSVKGRFTISRDNSKNTLYLQMGSLRAEDMAVYYCARVSPTGPYYGDYEGAFDYWGQGTLVTVSS

SEQ ID NO: 5275 - protein, 19 aa, Artificial Sequence
  Synthetic
ARVSPTGPYYGDYEGAFDY

SEQ ID NO: 5276 - protein, 108 aa, Artificial Sequence
  Synthetic
SYVLTQPPSVSVAPGKTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 5277 - protein, 11 aa, Artificial Sequence
  Synthetic
QVWDSSSDHVV

SEQ ID NO: 5278 - protein, 124 aa, Artificial Sequence
  Synthetic
QVQLVQSGAEVKKPQSSVKVSCTASGGSFRNYAISWVRQAPGEMGRTIPILGIGNYAQKFQGRVTITADKSTSTAYMQLSSLRSEDTAVYYCARETWYYDRSGYPRSDEYFQYWGQGTLVTVSS

SEQ ID NO: 5279 - protein, 21 aa, Artificial Sequence
  Synthetic
ARETWYYDRSGYPRSDEYFQY

SEQ ID NO: 5280 - protein, 111 aa, Artificial Sequence
  Synthetic
QSVLTQPPSVSGAPGQRVTISCTGSSSNIGAGYDVHWYQQLPGTSPKLLIYGNSNRPSGVPDRFSGSKSGTSASLAITGLQAEDEADYYCQSYDSSLSGLVFGGGTKLTVL

SEQ ID NO: 5281 - protein, 11 aa, Artificial Sequence
  Synthetic
QSYDSSLSGLV

SEQ ID NO: 5282 - protein, 131 aa, Artificial Sequence
  Synthetic
EVQLVESGGGLVQPGGSLRLSCAASGFTFSRYSMNWVRQAPGKGLEWVSYITSGSSSIHYADSVKGRFTISRDNAKYSLQMNSLRAEDTAVYYCARDSATYYYGSGVRHGYISGPEYFQYWGQGTLVTVSS

SEQ ID NO: 5283 - protein, 26 aa, Artificial Sequence
  Synthetic
ARDSATYYYGSGVRHGYISGPEYFQY

SEQ ID NO: 5284 - protein, 111 aa, Artificial Sequence
  Synthetic
QSVLTQPPSVSGAPGQRVTISCTGSSSNIGADSDVHWYQQLPGTAPKLLIYGNSNRPSGVPDRFSGSKSGTSASLAITGLQAEDEADYYCQSYDSSLSAVLFGGGTKLTVL

SEQ ID NO: 5285 - protein, 11 aa, Artificial Sequence
  Synthetic
QSYDSSLSAVL

SEQ ID NO: 5286 - protein, 129 aa, Artificial Sequence
  Synthetic
QVQLVESGGGVVQPGGSLRLSCAASGFTFSSYGMHWVRQAPGKGLEWVAFILYDGSNKYYADSVKGRFTISRDNSKYTLYLQMNSLRAEDTAVYYCAKDPVGGYCSGGSCYDFYGMDVWGQGTTVTVSS

SEQ ID NO: 5287 - protein, 22 aa, Artificial Sequence
  Synthetic
AKDPVGGYCSGGSCYDFYGMDV

SEQ ID NO: 5288 - protein, 109 aa, Artificial Sequence
  Synthetic
NFMLTQPHSVSESPGKTVTISCTRSSGSIASNYVQWYQQRPGSSPTTVIYEDNQRPSGVPDRFSGSIDSSSNSASLTISGLQTEDEADYYCQSSDSSTVVFGGGTKLTV

SEQ ID NO: 5289 - protein, 9 aa, Artificial Sequence
  Synthetic
QSSDSSTVV

SEQ ID NO: 5290 - protein, 128 aa, Artificial Sequence
  Synthetic
QVQLVQSGAEVKKPGSSVKVSCKASGYTFSSYAISWVRQAPGQGLEWMGGIIPILGIANYAQKFQGRVTITADKSTSTAYMELSSLRSEDTAVYYCARVLYYYDSSGYYRTDDAFDIWGQGTMVTVSS

SEQ ID NO: 5291 - protein, 21 aa, Artificial Sequence
  Synthetic
ARVLYYYDSSGYYRTDDAFDI

SEQ ID NO: 5292 - protein, 110 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGHVVFGGGTKLT

SEQ ID NO: 5293 - protein, 12 aa, Artificial Sequence
  Synthetic
QSYDSSLSGHVV

SEQ ID NO: 5294 - protein, 127 aa, Artificial Sequence
  Synthetic
QVQLVQSGAEVKKPGSSVKVSCKASGGTFSRYAISWVRQAPGQGLEWMGRIIPILGIANYAQKFQGRVTITADKSTSIAYMELSSLRSEDTAVYYCARVLFYYDTSGPRSDDAFDIWGQGTMVTVSS

SEQ ID NO: 5295 - protein, 20 aa, Artificial Sequence
  Synthetic
ARVLFYYDTSGPRSDDAFDI

SEQ ID NO: 5296 - protein, 109 aa, Artificial Sequence
  Synthetic
QFVLTQPPSVSGAPGQRVTISCTGSSSNIGAGYDVHWYQQLPGTAPKLLIYGNSNRPSGVPDRFSGSKSGTSASLAITGLQAEDEGDYYCQSYDSSLNGSGVFGGGTKL

SEQ ID NO: 5297 - protein, 12 aa, Artificial Sequence
  Synthetic
QSYDSSLNGSGV

SEQ ID NO: 5298 - protein, 127 aa, Artificial Sequence
  Synthetic
EVQLVESGGGLVKPGGSLRLSCAASGFSFSNAWMNWVRQAPGKGLEWVGRIKSKIDGGTTDYAAPVKGRFTISRDDSKNMLYLQMNSLKTEDTAVYYCTTAIDIVVTVYVDDAFDIWGQGTMVTVSS

SEQ ID NO: 5299 - protein, 18 aa, Artificial Sequence
  Synthetic
TTAIDIVVTVYVDDAFDI

SEQ ID NO: 5300 - protein, 108 aa, Artificial Sequence
  Synthetic
QSVLTQPASVSGSPGQSITISCTGTSSDVGGYNYVSWYQHYPGKAPKLMIYEVTHRPSGVSNRFSGSKSGNTASLTISGLQAEDEADYYCSSSTNSSTWVFGGGTKMT

SEQ ID NO: 5301 - protein, 10 aa, Artificial Sequence
  Synthetic
SSSTNSSTWV

SEQ ID NO: 5302 - protein, 124 aa, Artificial Sequence
  Synthetic
EVQLVESGGGLVQPGGSLRLSCSASGFTFSSYAMHWVRQAPGKGLEYVSGVSSNGGSPYYADSVKGRFTISRDISKNTLYLQMSSLRAEDTAVYYCVKDLGYGSAWYAPPFDYWGQGTLVTVSS

SEQ ID NO: 5303 - protein, 17 aa, Artificial Sequence
  Synthetic
VKDLGYGSAWYAPPFDY

SEQ ID NO: 5304 - protein, 105 aa, Artificial Sequence
  Synthetic
SYVLTQPPSVSVAPGKTARITCGGNSIGSKSVHWYQQKPGQAPVLVIYYDNDRPSGIPERFSGSNSGNTATLTINRVEAGDEADYYCQVWDSSVVFGGGTKLTVL

SEQ ID NO: 5305 - protein, 8 aa, Artificial Sequence
  Synthetic
QVWDSSVV

SEQ ID NO: 5306 - protein, 123 aa, Artificial Sequence
  Synthetic
QLQLQESGPGLVKPSETLSLTCTISGGSISSSSYYWGWIRQPPGKGLEWIGNIYNSGSTYYNPSLKSRVTISVDTSKNQVSLKLSSVTAADTAVYYCARVLTIFGVVIQFDYWGQGTLVTVSS

SEQ ID NO: 5307 - protein, 15 aa, Artificial Sequence
  Synthetic
ARVLTIFGVVIQFDY

SEQ ID NO: 5308 - protein, 111 aa, Artificial Sequence
  Synthetic
NFMLTQPHSVSESPGKTVTISCTRSSGSIASHYVQWYQQRPGSSPTIVIYEDNQRPSGVPDRFSGSIDSSSNSASLTISGLKTEDEADYYCQSYDANTYVEFGGGTKLTVL

SEQ ID NO: 5309 - protein, 10 aa, Artificial Sequence
  Synthetic
QSYDANTYVE

SEQ ID NO: 5310 - protein, 125 aa, Artificial Sequence
  Synthetic
EVQLVESGGGLVQPGGSLRLSCSASGFTFSSYAMHWVRQAPGKGLEYVSVNGGSTYYADSVKGRFTISRDNSKNTLYLQMSSLRAEDTAVYYCVKDWSTCSSTSCYPAGDAFDIWGQGTMVTVSS

SEQ ID NO: 5311 - protein, 21 aa, Artificial Sequence
  Synthetic
VKDWSTCSSTSCYPAGDAFDI

SEQ ID NO: 5312 - protein, 108 aa, Artificial Sequence
  Synthetic
SYVLTQPPSVSVAPGKTARITCGGNNIGSKSVHWYQQKPGQAPVQVIYYDSDRPSGIPERFSGSNSGNTATLTISRVEAGDEADYYCQVWDSSSDHVVFGGGTKLTVL

SEQ ID NO: 5313 - protein, 11 aa, Artificial Sequence
  Synthetic
QVWDSSSDHVV

SEQ ID NO: 5314 - protein, 132 aa, Artificial Sequence
  Synthetic
EVQLVQSGAEVKKPGESLKISCKGSGYSFTSYWIGWVRQMPGKGLEWMGIIYPGDSDTRYSPSFQGQVTISADKSISTAYLQRSSLKASDTAMYYCARLRFSTRLLVLFGEFKFHYYGVDIWGQGTTVTVSS

SEQ ID NO: 5315 - protein, 25 aa, Artificial Sequence
  Synthetic
ARLRFSTRLLVLFGEFKFHYYGVDI

SEQ ID NO: 5316 - protein, 111 aa, Artificial Sequence
  Synthetic
QSVLTQPASVSGSPGQSITISCTGTSSDVGGYNFVSWYQQHPGKAPKLMIYDVSNRPSGVSNRFSGSKSGNTASLTVSGLQAEDEADYYCSSYTSSSALEVFGGGTKLTVL

SEQ ID NO: 5317 - protein, 11 aa, Artificial Sequence
  Synthetic
SSYTSSSALEV

SEQ ID NO: 5318 - protein, 119 aa, Artificial Sequence
  Synthetic
EVQLVESGGGLVQPGGSLRLSCAASGVTFSSYWMYWVRQAPGKGLVWVSRINSDGSSTSYADSVKGRFTISRDNAKYTLYLQMNSLRAEDTAVYYCARARWLQGEFDYWGRGTLVTVSS

SEQ ID NO: 5319 - protein, 12 aa, Artificial Sequence
  Synthetic
ARARWLQGEFDY

SEQ ID NO: 5320 - protein, 111 aa, Artificial Sequence
  Synthetic
NFMLTQPHSVSESPGKTVTISCTRSSGSIATNYVQWYQQRPGSSPTTVIYEDNQRPSGVPDRFSGSIDSSSNSASLTISGLKTEDEADYYCQSYDSSNGVVFGGGTKLTVL

SEQ ID NO: 5321 - protein, 10 aa, Artificial Sequence
  Synthetic
QSYDSSNGVV

SEQ ID NO: 5322 - protein, 122 aa, Artificial Sequence
  Synthetic
EVQLVESGGVVVQPGGSLRLSCAASGFTFDDYAMHWVRQAPGKGLEWVSLISWDGGSTYYADSVKGRFTISRDNSKNSLYLQMNSLRAEDTALYYCAKVGTTTCHTCYFDHWGQGTLVTVSS

SEQ ID NO: 5323 - protein, 15 aa, Artificial Sequence
  Synthetic
AKVGTTTCHTCYFDH

SEQ ID NO: 5324 - protein, 110 aa, Artificial Sequence
  Synthetic
QSVLTQPRSVSGSPGQSVTISCTGTSSDVGGYNFVSWYQQHPGKAPKLMIFDVSKRPSGVPDRFSGSKSGSTASLTISGLQAEDEADYYCCSYAGFYTLVFGGGTKLTVL

SEQ ID NO: 5325 - protein, 10 aa, Artificial Sequence
  Synthetic
CSYAGFYTLV

SEQ ID NO: 5326 - protein, 125 aa, Artificial Sequence
  Synthetic
EVQLVESGGGLVRPGGSLRLSCSASGFTFSTYAMYWVRQAPGKGLEYVSGISSNGGSTYQADSMKGRFTISRDNSKNTLYLQMSSLRAEDTAVYYCAGGLAYCSGDCYSEYFHHWGQGTLVTVSS

SEQ ID NO: 5327 - protein, 18 aa, Artificial Sequence
  Synthetic
AGGLAYCSGDCYSEYFHH

SEQ ID NO: 5328 - protein, 108 aa, Artificial Sequence
  Synthetic
SYELTQPPSVSVSPGQTARITCSGDALAMQHAYWYQQKPGQAPMLVIYKDSERPSGIPERFSGSSSGTTVTLTISGVQAEDEADYYCQSADSSGTHVVFGGGTKLTVL

SEQ ID NO: 5329 - protein, 11 aa, Artificial Sequence
  Synthetic
QSADSSGTHVV

SEQ ID NO: 5330 - protein, 132 aa, Artificial Sequence
  Synthetic
QVQLVQSGAEVKKPGSSVKVSCKASGGTFSSYAISWVRQAPGQGLEWMGRIIPILGIGNYAQKFQGRVAQKFQGRVTITADKSTSTAYMELNSLRSEDTAVYFCARDDYSNYDYYYYGMDVWGQGTTVTVAS

SEQ ID NO: 5331 - protein, 17 aa, Artificial Sequence
  Synthetic
ARDDYSNYDYYYYGMDV

SEQ ID NO: 5332 - protein, 110 aa, Artificial Sequence
  Synthetic
QSVLTQPPSASGTPGQRVTISCSGSSSNIGSNFVNWYQQLPGTAPKLLIYSNNQRPSGVPDRFSGSKSGTSASLAISGLQSEDEADYYCAAWEDSLNGPVFGGGTKLTVL

SEQ ID NO: 5333 - protein, 11 aa, Artificial Sequence
  Synthetic
AAWEDSLNGPV

SEQ ID NO: 5334 - protein, 131 aa, Artificial Sequence
  Synthetic
QVQLQESGPGLVKPSETLSLTCTVSGYSINSGWYWGWIRQPPGKGLEWIGSISYSGSTYYNPSLKSRVTISLDTSKNQFSLKVSSVTAADTAEYYCARDENDDYDSSDYYYPRQKCYFEYWGQGTLVTVSS

SEQ ID NO: 5335 - protein, 24 aa, Artificial Sequence
  Synthetic
ARDENDDYDSSDYYYPRQKCYFEY

SEQ ID NO: 5336 - protein, 106 aa, Artificial Sequence
  Synthetic
SYVLTQPPSVSVSPGQTASITCSGNKLGDKYACWYQQKPGQSPVLVIYQDSKRPSGIPERFSGSNSGNTATLTISGTQAMDEADYYCQAWDSRTYVFGTGTKVTVL

SEQ ID NO: 5337 - protein, 9 aa, Artificial Sequence
  Synthetic
QAWDSRTYV

SEQ ID NO: 5338 - protein, 125 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARLTLTRWELEDYYYGMDVWGQGTTVTVSS

SEQ ID NO: 5339 - protein, 19 aa, Artificial Sequence
  Synthetic
ARLTLTRWELEDYYYGMDV

SEQ ID NO: 5340 - protein, 110 aa, Artificial Sequence
  Synthetic
QSVLTQPPSVSAAPGQKVTISCSGSSSNIGNNYVSWYQQLPGTAPKLLIYENNKRPSGIPDRFSGSKSGTSATLGITGLQTGDEADYYCGIWDSSLSVWVFGGGTKLTVL

SEQ ID NO: 5341 - protein, 11 aa, Artificial Sequence
  Synthetic
GIWDSSLSVWV

SEQ ID NO: 5342 - protein, 121 aa, Artificial Sequence
  Synthetic
QVQLQQWGAGLLKPSETLSLTCAVYGGSFSAYYWSWIRQPPGKGLEWIGEIYHSGSTNYNPSLKSRVTISVDTSKNQFSLKLTSVTAADTAVYYCARQDWGESSHWYFDLWGRGTLVTVSS

SEQ ID NO: 5343 - protein, 15 aa, Artificial Sequence
  Synthetic
ARQDWGESSHWYFDL

SEQ ID NO: 5344 - protein, 112 aa, Artificial Sequence
  Synthetic
QSVLTQPPSVSGAPGQRVTISCTGSSSNIGAGYDVHWYQHLPGTAPKLLIYGNSNRPSGVPDRFSGSKSGTSASLAITGLQAEDEADYCCQSYDSSLSGFVVFGGGTKLTVL

SEQ ID NO: 5345 - protein, 12 aa, Artificial Sequence
  Synthetic
QSYDSSLSGFVV

SEQ ID NO: 5346 - protein, 131 aa, Artificial Sequence
  Synthetic
QVQLVESGGGVVQPGGSLRLSCAASGFIFSNYGMHWVRQAPGKGLEWVAFIRYDGSNKYYVDSVKGRFTFSRDNSKNTLYLQMNSLRAEDTAVYYCAKDGGPYYYDRSGYARDDYYGMDVWGQGTTVTVSS

SEQ ID NO: 5347 - protein, 24 aa, Artificial Sequence
  Synthetic
AKDGGPYYYDRSGYARDDYYGMDV

SEQ ID NO: 5348 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVWVFGGGTKLTVL

SEQ ID NO: 5349 - protein, 11 aa, Artificial Sequence
  Synthetic
QSYDSSLSVWV

SEQ ID NO: 5350 - protein, 121 aa, Artificial Sequence
  Synthetic
EVQLVESGGGLVQPGGSLRLSCAASGFTFSSYAMSWVRQAPGKGLEWVSAISGGGGSTDYADSVKGRFTISRDNSKNTLYLQMNSLRAEDTAVYYCVMDTVLITDRYFDYWGQGSLVTVSS

SEQ ID NO: 5351 - protein, 14 aa, Artificial Sequence
  Synthetic
VMDTVLITDRYFDY

SEQ ID NO: 5352 - protein, 106 aa, Artificial Sequence
  Synthetic
SYVLTQPPSVSVSPGQTARITCSGDALPNQYAYWYQQKPGQAPVLVIYKDSERPSGIPERFSGSTSGTTVTLTISGVQAEDEADYYCQSADSSGVVFGGGTKLTVL

SEQ ID NO: 5353 - protein, 9 aa, Artificial Sequence
  Synthetic
QSADSSGVV

SEQ ID NO: 5354 - protein, 121 aa, Artificial Sequence
  Synthetic
EVQLVESGGGLVQPGGSLRLSCAASGLTVSSNYMTWVRQAPGKGLEWVSVIYSGGSTYYADSVKGRFTISRDNSKNTLYLQMNSLRAEDTAVYYCARGDSYDNYYYGMDVWGQGTTVTVSS

SEQ ID NO: 5355 - protein, 15 aa, Artificial Sequence
  Synthetic
ARGDSYDNYYYGMDV

SEQ ID NO: 5356 - protein, 111 aa, Artificial Sequence
  Synthetic
QSVLTQPPSVSGAPGQRVTISCTGSSSNIGAGYDVHWYQQLPGTAPKLLIYGNINRPSGVPDRFSGSRSGTSASLAITGLQAEDEADYYCQSYDSSLSGSVFGGGTKLTVL

SEQ ID NO: 5357 - protein, 11 aa, Artificial Sequence
  Synthetic
QSYDSSLSGSV

SEQ ID NO: 5358 - protein, 121 aa, Artificial Sequence
  Synthetic
QVQLVESGGGVVQPGRSLRLSCAASGFTLSSHGMNWVRQAPGKGLEWVAVIWYDGSNKYYADSVKGRFTISRDNSKNTLDLQMNSLRAEDTAVYYCARDRMSSSWANFDYWGQGTLVTVSS

SEQ ID NO: 5359 - protein, 14 aa, Artificial Sequence
  Synthetic
ARDRMSSSWANFDY

SEQ ID NO: 5360 - protein, 112 aa, Artificial Sequence
  Synthetic
NFVLTQPHSVSESPGKTVTISCTRSSGSIASNYVQWYQQRPGSSPTTVIYEDNQRPSGVPDRFSGSIDSSSNSASLTISGLKTEDEADYYCQSYDSSKHHVVFGGGTKLTVL

SEQ ID NO: 5361 - protein, 11 aa, Artificial Sequence
  Synthetic
QSYDSSKHHVV

SEQ ID NO: 5362 - protein, 124 aa, Artificial Sequence
  Synthetic
QVQLVQSGAEVKKPGASVKVSCKASGYTFTSYGITWVRQAPGQGLEWMGWISAYNGDTNYAQKLQGRVTMTTDTSTSTAYMELRSLRSDDTAVYYCARFTYRSGSYLWYTSDYWGHGTLVTVSS

SEQ ID NO: 5363 - protein, 17 aa, Artificial Sequence
  Synthetic
ARFTYRSGSYLWYTSDY

SEQ ID NO: 5364 - protein, 111 aa, Artificial Sequence
  Synthetic
QSVLTQPASVSGSPGQSITISCTGTSSEVGGYNFVSWFQQHPGKAPKLMIYDVSNRPSGVSNRFSGSKSGNTASLTISGLQAEDEADYYCSSYTSSTTLVVFGGGTKLTVL

SEQ ID NO: 5365 - protein, 11 aa, Artificial Sequence
  Synthetic
SSYTSSTTLVV

SEQ ID NO: 5366 - protein, 123 aa, Artificial Sequence
  Synthetic
EVQLVESGGGLVKPGGSLRLSCAASGFTFSYAWMDWVRQVPGKGLEWVGRIKDKIDGGTTDYAAPVKGRFTISRDDSKNTLYLQMNSLKTEDTAVYYCTTDWNPFTIFGVLYWGQGTLVTVSS

SEQ ID NO: 5367 - protein, 14 aa, Artificial Sequence
  Synthetic
TTDWNPFTIFGVLY

SEQ ID NO: 5368 - protein, 111 aa, Artificial Sequence
  Synthetic
QSVLTQSSSASASLGSSVKLTCTLSSGHSSYIIAWHQQQPGKAPRYLMKLEGSGSYNKGSGVPDRFSGSSSGADRYLTISNLQFEDETDYYCETWDSNSRVFGGGTKLTVL

SEQ ID NO: 5369 - protein, 9 aa, Artificial Sequence
  Synthetic
ETWDSNSRV

SEQ ID NO: 5370 - protein, 123 aa, Artificial Sequence
  Synthetic
QLQLQESGPGLVKPSETLSLTCTVSGGSISSSSYYWGWIRQPPGKGLEWIGSIHYSGSTYYNPSLKSRVTISVDTSKNHFSLKLSSVTAADTAVYYCARSIAIFGVVINFDYWGQGTLVTVSS

SEQ ID NO: 5371 - protein, 15 aa, Artificial Sequence
  Synthetic
ARSIAIFGVVINFDY

SEQ ID NO: 5372 - protein, 111 aa, Artificial Sequence
  Synthetic
NFVLTQPHSVSESPGKTVTISCTRSSGSIASHYVQWYQQRPGSSPTTVIYEDNQRPSGVPDRFFGSIDSSSNSASLTISGLKTEDEADYHCQSYDSSNLVVFGGGTKLTVL

SEQ ID NO: 5373 - protein, 10 aa, Artificial Sequence
  Synthetic
QSYDSSNLVV

SEQ ID NO: 5374 - protein, 120 aa, Artificial Sequence
  Synthetic
EVQLVESGGGLVQPGGSLRLSCSASGFTFSSYAMHWVRQAPGKGLEYVSGISSNGDSPYADSVKGRFTISRDNSKNTLYLQMSSLRAEDTAVYYCVKVSSGSYWGWFDPWGQGTLVTVSS

SEQ ID NO: 5375 - protein, 14 aa, Artificial Sequence
  Synthetic
VKVSSGSYWGWFDP

SEQ ID NO: 5376 - protein, 105 aa, Artificial Sequence
  Synthetic
SYVLTQPPSVSVAPGKTARITCGGDNIGSKSVHWYQQKPGQAPVLVVHDDSDRPSGIPERFSGSNSGNTATLTISRVEAGDEADYYCQVWDSSVVFGGGTKLTVL

SEQ ID NO: 5377 - protein, 8 aa, Artificial Sequence
  Synthetic
QVWDSSVV

SEQ ID NO: 5378 - protein, 127 aa, Artificial Sequence
  Synthetic
QVQLVQSGAEVKKPGSSVKVSCKASGGTFSTYTINWVRQAPGQGLEWMGGIIPFLGIANYAQKFQGRVMITADKSTSTAYMELNSLRSEDTAVYYCARQGVLYYESSGLMAHYFDYWGQGTLVTVSS

SEQ ID NO: 5379 - protein, 20 aa, Artificial Sequence
  Synthetic
ARQGVLYYESSGLMAHYFDY

SEQ ID NO: 5380 - protein, 111 aa, Artificial Sequence
  Synthetic
QSVLTQPPSVSGAPGQRVTISCTGSSSNIEAGYDVHWYQQLPGTAPKLLIYGNTNRPSGVPDRFSGSQSGTLASLAITGLQAEDEADYYCQSYDSSLSGSVFGTGTKVTVL

SEQ ID NO: 5381 - protein, 11 aa, Artificial Sequence
  Synthetic
QSYDSSLSGSV

SEQ ID NO: 5382 - protein, 127 aa, Artificial Sequence
  Synthetic
QVQLVQSGAEVKKPGSSVKVSCKASGGTFSNYGISWVRQAPGQGLEWMGRIIPMFGIANYAQKFQGRVTITADKSTSTVYMELASLRSEDTAVYYCARDQWESDYYDNSDYYYVDYWGQGTLVTVSS

SEQ ID NO: 5383 - protein, 20 aa, Artificial Sequence
  Synthetic
ARDQWESDYYDNSDYYYVDY

SEQ ID NO: 5384 - protein, 111 aa, Artificial Sequence
  Synthetic
QSVLTQPPSVSGAPGQRVTISCTGSSSNIGAGYDVHWYQQLPGTAPKLLIYDNSNRPSGVPDRFSGSKSGTSASLAITGLQAEDEADYHCQSYDRSLSDVVFGGGTKLTVL

SEQ ID NO: 5385 - protein, 11 aa, Artificial Sequence
  Synthetic
QSYDRSLSDVV

SEQ ID NO: 5386 - protein, 123 aa, Artificial Sequence
  Synthetic
QVQLVESGGGVVQPGRSLRLSCAASGFTFSSYALHWVRQAPGKGLEWVALISYDGSNKHYADSVKGRFTISRDNSKNTLYLQMNSLRVEDTAVYYCARDYCGSTSCPYLFDYWGQGTLVTVSS

SEQ ID NO: 5387 - protein, 16 aa, Artificial Sequence
  Synthetic
ARDYCGSTSCPYLFDY

SEQ ID NO: 5388 - protein, 109 aa, Artificial Sequence
  Synthetic
SYVLTQPPSVSVAPGETARITCGGNNIGSKSVHWYQQKPGQAPVLVVYDDSDRPSGIPERFSGSNSGNTATLTISRVEAGDEADYYCQVWDISIDHVVVFGGGTKLTVL

SEQ ID NO: 5389 - protein, 12 aa, Artificial Sequence
  Synthetic
QVWDISIDHVVV

SEQ ID NO: 5390 - protein, 131 aa, Artificial Sequence
  Synthetic
EVQLVESGGGLVQPGGSLRLSCVASGFTVSSNYMSWVRQAPGKGLEWVSIIDSGGSTYYADSVKGRFTISRDNSKNTLYLQMNSLRAEDTAVYYCARTPFRYYDSSGNYYDGYYYYGMDVWGQGTTVTVSS

SEQ ID NO: 5391 - protein, 25 aa, Artificial Sequence
  Synthetic
ARTPFRYYDSSGNYYDGYYYYGMDV

SEQ ID NO: 5392 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSVSLAITGLQAEDEADYYCQSYDNTLSGWVFGGGTKLTVL

SEQ ID NO: 5393 - protein, 11 aa, Artificial Sequence
  Synthetic
QSYDNTLSGWV

SEQ ID NO: 5394 - protein, 125 aa, Artificial Sequence
  Synthetic
EVQLVESGGGLVQPGGSLRLSCVGSGFTFSTYAMRWVRQAPGKGLKWISEISATDDSTHYADSVKGRFIISRDNSKNTVYLQMNSLTAEDTAVYYCAKLASTSWTVYFYHAMDVWGQGTTVTVSS

SEQ ID NO: 5395 - protein, 18 aa, Artificial Sequence
  Synthetic
AKLASTSWTVYFYHAMDV

SEQ ID NO: 5396 - protein, 106 aa, Artificial Sequence
  Synthetic
SYVLTQPPSVSVAPGKTATITCGGDNIGIKSVHWYQQKPGQAPVLVVYDDRDRPSGIPERFSGSNSGNPATLTISRVEAGDEADYYCQLWESSSVVFGGGTKLTVL

SEQ ID NO: 5397 - protein, 9 aa, Artificial Sequence
  Synthetic
QLWESSSVV

SEQ ID NO: 5398 - protein, 127 aa, Artificial Sequence
  Synthetic
EVQLVESGGGLVQPGGSLRLSCAASGFTFSSYAMNWVRQAPGKGLEWVSGISGRGGSTYYADSVKGRFTFSRDNSKNTLYLQMNSLRAEDTAVYYCAKGQGAYSAYDPDYYYGMDVWGQGTTVTVSS

SEQ ID NO: 5399 - protein, 20 aa, Artificial Sequence
  Synthetic
AKGQGAYSAYDPDYYYGMDV

SEQ ID NO: 5400 - protein, 106 aa, Artificial Sequence
  Synthetic
SYVLTQPPSVSVSPGQTARITCSGDALPKQYSYWYQQKPGQAPVLVIYKESERPSGIPERFSGSSSGTTVTLTISRVQAEDEADYYCQSADYSGTYMFGGGTRLTV

SEQ ID NO: 5401 - protein, 10 aa, Artificial Sequence
  Synthetic
QSADYSGTYM

SEQ ID NO: 5402 - protein, 124 aa, Artificial Sequence
  Synthetic
QVQLVESGGGVVQPGRSLRLSCAASGFTFSSYGMHWVRQAPGRGLEWVAVIAYDGSNKYYADSVKGRFTISRDNSKNTLYLQMNSLRGEDTAVYYCAKDPWDGHNPRGDYFDYWGQGTLVTVSS

SEQ ID NO: 5403 - protein, 17 aa, Artificial Sequence
  Synthetic
AKDPWDGHNPRGDYFDY

SEQ ID NO: 5404 - protein, 109 aa, Artificial Sequence
  Synthetic
SYVLTQPPSVSVAPGKTARITCGGDNIGSKNVHWYQQKPGQAPVLIVYDDSDRPSGIPERFSGSNSGNTATLTISRVEAGDEADYYCQVWDSSGDHFWVFGGGTKLTVL

SEQ ID NO: 5405 - protein, 12 aa, Artificial Sequence
  Synthetic
QVWDSSGDHFWV

SEQ ID NO: 5406 - protein, 126 aa, Artificial Sequence
  Synthetic
EVQLVQSGAEVKKPGESLKISCKGSGYRFTSYWIGWVRQMPGKGLEWMGIIYPDDSDTRYSPSFQGQVIISADKSISTAYLQWSSLKASDTAMYYCARHLRAYCGGDCYSPSFDYWGQGTLVTVSS

SEQ ID NO: 5407 - protein, 19 aa, Artificial Sequence
  Synthetic
ARHLRAYCGGDCYSPSFDY

SEQ ID NO: 5408 - protein, 111 aa, Artificial Sequence
  Synthetic
QSVLTQPASVSGSPGQSITISCTGTSSDVDNYNYVSWYQQHPGKAPKLMIFDVTNRPSGVSSRFSGSKSGNTASLTISGLQAEDEADYYCSSYTSGSTHVVFGGGTKLTVL

SEQ ID NO: 5409 - protein, 11 aa, Artificial Sequence
  Synthetic
SSYTSGSTHVV

SEQ ID NO: 5410 - protein, 129 aa, Artificial Sequence
  Synthetic
QVQLVESGGGVVQPGGSLRLSCAASGFTFSSYGMHWVRQAPGKGLEWVAFILYDGSNKYYVDSVKGRFTISRDNSKNTLYLQMNSLRAEDTAVYYCVKDPVGGYCRGGNCYDFYAMDVWGQGTTVTVSS

SEQ ID NO: 5411 - protein, 22 aa, Artificial Sequence
  Synthetic
VKDPVGGYCRGGNCYDFYAMDV

SEQ ID NO: 5412 - protein, 110 aa, Artificial Sequence
  Synthetic
NFVLTQPHSVSESPGKTVTISCTRSSGSIASNYVQWYQQRPGSSPTTVIYEDNQRPSGVPDRFSGSIDSSSNSASLTISGLKTEDEADYYCQSSDSSTVVFGGGTKLTVL

SEQ ID NO: 5413 - protein, 9 aa, Artificial Sequence
  Synthetic
QSSDSSTVV

SEQ ID NO: 5414 - protein, 121 aa, Artificial Sequence; identical to SEQ ID NO: 5146
  Synthetic

SEQ ID NO: 5415 - protein, 15 aa, Artificial Sequence
  Synthetic
ARVEYSSDIYWYFDL

SEQ ID NO: 5416 - protein, 108 aa, Artificial Sequence
  Synthetic
SYVLTQPPSVSVAPGRTASIACEGNNFGGRSVHWYRQKPGQAPVLVVYDDSDRPSGIPERFSGSKSGNTATLTISRVEAGDEADYYCQVWDSSSDHVVFGGGTKLTVL

SEQ ID NO: 5417 - protein, 11 aa, Artificial Sequence
  Synthetic
QVWDSSSDHVV

SEQ ID NO: 5418 - protein, 125 aa, Artificial Sequence
  Synthetic
EVQLVESGGGLVQPGGSLRLSCVGSGFTFSTYAMRWVRQAPGKGLKWVSEVSATDGSTHYADSVKGRFIISRDNSKNTVYLQMNSLTAEDTAVYYCAKLASTSWTVYFYHAMDVWGQGTTVTVSS

SEQ ID NO: 5419 - protein, 18 aa, Artificial Sequence
  Synthetic
AKLASTSWTVYFYHAMDV

SEQ ID NO: 5420 - protein, 106 aa, Artificial Sequence
  Synthetic
SYVLTQPPSVSVAPGKTATITCGGDNIGIKSVHWYQQKPGQAPVLVLYDDRDRPSGIPERFSGSNSGNPATLTISRVEAADEADYYCQLWESSTVVFGGGTKLTVL

SEQ ID NO: 5421 - protein, 9 aa, Artificial Sequence
  Synthetic
QLWESSTVV

SEQ ID NO: 5422 - protein, 126 aa, Artificial Sequence
  Synthetic
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARRYFDSSGYYYDDGYFDYWGQGTLVTVSS

SEQ ID NO: 5423 - protein, 19 aa, Artificial Sequence
  Synthetic
ARRYFDSSGYYYDDGYFDY

SEQ ID NO: 5424 - protein, 106 aa, Artificial Sequence
  Synthetic
SYVLTQPPSVSVSPGQTARITCSGDALPKQYAYWYQQKPGQAPVLVIYKDSERPSGIPERFSGSSSGTTVTLTISGVQAEDEADYYCQSADSSGVVFGGGTKLTVL

SEQ ID NO: 5425 - protein, 9 aa, Artificial Sequence
  Synthetic
QSADSSGVV

SEQ ID NO: 5426 - protein, 128 aa, Artificial Sequence
  Synthetic
QVQLVQSGAEVKKPGASVKVSCKASGYTFSSNGISWVRQAPGQGLEWMGWISAYNGNTNYAQKLQGRVTMTTDTSTSTAYMELRSLRSDDTAVYYCARDLGSSGYYDSSDSYVDFDYWGQGTLVTVSS

SEQ ID NO: 5427 - protein, 21 aa, Artificial Sequence
  Synthetic
ARDLGSSGYYDSSDSYVDFDY

SEQ ID NO: 5428 - protein, 106 aa, Artificial Sequence
  Synthetic
SYVLTQPSSVSVSPGQTARITCSGDVLAKKYARWFQQKPGQAPVLVIYKDTERPSGIPERFSGSSSGTTVTLTISGAQVEDEADYYCYSAADNNRVFGGGTKLTVL

SEQ ID NO: 5429 - protein, 9 aa, Artificial Sequence
  Synthetic
YSAADNNRV

SEQ ID NO: 5430 - protein, 123 aa, Artificial Sequence
  Synthetic
EVQLVESGGGLVQPGRSLRLSCTGSGFTFGDYAMSWFRQAPGKGLEWVGFIRSKAFGGTTQYAASVKGRFTISRDDSKSIAYLQMNSLKTEDTAVYYCTRDLSMIGTRYFDLWGRGTLVTVSS

SEQ ID NO: 5431 - protein, 14 aa, Artificial Sequence
  Synthetic
TRDLSMIGTRYFDL

SEQ ID NO: 5432 - protein, 106 aa, Artificial Sequence
  Synthetic
EIVMTQSPATLSVSPGERATLSCRASQSVSSKLAWYQQKPGQAPRLLIYDASTRATGIPARFSGSGSGTEFTLTISSLQSEDFAVYYCQQYNNWWTFGQGTKVEIK

SEQ ID NO: 5433 - protein, 8 aa, Artificial Sequence
  Synthetic
QQYNNWWT

SEQ ID NO: 5434 - protein, 122 aa, Artificial Sequence
  Synthetic
EVQLVESGGGLVQPGGSLRLSCSASGFTFSSYAMNWVRQAPGKGLEYVSAISSDGGITYYAESVKGRFTISRDNSKNTLYLQMSSLRAEDTAMYYCVKDLGTTVTTDVFDMWGQGTMVTVSS

SEQ ID NO: 5435 - protein, 15 aa, Artificial Sequence
  Synthetic
VKDLGTTVTTDVFDM

SEQ ID NO: 5436 - protein, 107 aa, Artificial Sequence
  Synthetic
DIQMTQSPSSLSASVGDRVTITCRASQSINIYLNWYQQKAGKAPRLLIYAASSLQSRVPSRFSGSGSGTDFTLTISSLQPEDFATYYCQQSYSTPGTFGQGTKVEIK

SEQ ID NO: 5437 - protein, 9 aa, Artificial Sequence
  Synthetic
QQSYSTPGT

SEQ ID NO: 5438 - protein, 116 aa, Artificial Sequence
  Synthetic
QVQLQQWGAGLLKPSETLSLTCAVYGGSYYWSWIRQPPGKGLEWIGEINHSGSTNYSPSLQSRVTISVDTSKNHFSLKLTSVTAADTAVYYCARLVLEYSFGLDYWGQGTLVTVSS

SEQ ID NO: 5439 - protein, 13 aa, Artificial Sequence
  Synthetic
ARLVLEYSFGLDY

SEQ ID NO: 5440 - protein, 107 aa, Artificial Sequence
  Synthetic
DIQMTQSPSSLSASVGDRVTITCRASQSVSHFLNWYQQKPGKAPNLLIYAASSLQSGVPSRFSGSGSGTDFSLTISSLQPEDFATYYCQQSYTIPNTFGQGTKLEIK

SEQ ID NO: 5441 - protein, 9 aa, Artificial Sequence
  Synthetic
QQSYTIPNT

SEQ ID NO: 5442 - protein, 125 aa, Artificial Sequence
  Synthetic
QVQLVESGGGVVQPGGSLRLSCAASGFTFSNYAMHWVRLAPGKGLEWVAFILYDGTNKYYADSVKGRFTISRDNSKNTLYLQMNSLRAEDTAVYYCAKGGLGIMIFGVDDDFDIWGQGTMVTVSS

SEQ ID NO: 5443 - protein, 18 aa, Artificial Sequence
  Synthetic
AKGGLGIMIFGVDDDFDI

SEQ ID NO: 5444 - protein, 113 aa, Artificial Sequence
  Synthetic
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPLWTFGQGTKVEIK

SEQ ID NO: 5445 - protein, 10 aa, Artificial Sequence
  Synthetic
MQGTHWPLWT

SEQ ID NO: 5446 - protein, 108 aa, Artificial Sequence
  Synthetic
  misc_feature (65)..(65): Xaa can be any naturally occurring amino acid
  misc_feature (67)..(67): Xaa can be any naturally occurring amino acid
QVQLVQSGAEVKKPGASVKVSCKTSGYTFTTFGISWVRQAPGQGLEWMGWISSYNGNTNYAQKLXGXISMTTDTSTSTGYMELRSLRSDDTAVYYCARVNRGGEDAFD

SEQ ID NO: 5447 - protein, 12 aa, Artificial Sequence
  Synthetic
ARVNRGGEDAFD

SEQ ID NO: 5448 - protein, 106 aa, Artificial Sequence
  Synthetic
DIQMTQSPSTLSASVGDRVTITCRASQSISRWLAWYQQKPGKAPKLLIYMASNLESGVPSRFSGSGSGTEFTLTISSLQPDDIATYYCQQYNTYSTFGQGTKVEIK

SEQ ID NO: 5449 - protein, 8 aa, Artificial Sequence
  Synthetic
QQYNTYST

SEQ ID NO: 5450 - protein, 126 aa, Artificial Sequence
  Synthetic
QVQLVQSGAEVKKPGASVKVSCKASGYTFTSYGISWVRQAPGQGLEWMGWISAYNGNTNYAQKLQGRVTMTTDTSTSTAYMELRSLTSDDTAVYYCTRDRAYSGYDALDDDVFDIWGQGTMVTVSS

SEQ ID NO: 5451 - protein, 19 aa, Artificial Sequence
  Synthetic
TRDRAYSGYDALDDDVFDI

SEQ ID NO: 5452 - protein, 107 aa, Artificial Sequence
  Synthetic
DIQMTQSPSTLSASVGDRVTITCRASQSISSWLAWYQQRPGKAPKLLIYMASSLESGVPSRFSGSGSGTEFTLTISSLQPDDFATYYCQQYNSYSYTFGQGTKLEIK

SEQ ID NO: 5453 - protein, 9 aa, Artificial Sequence
  Synthetic
QQYNSYSYT

SEQ ID NO: 5454 - protein, 127 aa, Artificial Sequence
  Synthetic
QVQLVQSGAEVKKPGSSVKVSCKASGGTFSSYTISWVRQAPGQGLEWMGGIIPILGIADYAQKFQGRVTITADKSTSTAYMELSSLRSEDTAVYYCARGSFRDPAMWGPMPEYFQHWGQGTLVTVSS

SEQ ID NO: 5455 - protein, 20 aa, Artificial Sequence
  Synthetic
ARGSFRDPAMWGPMPEYFQH

SEQ ID NO: 5456 - protein, 106 aa, Artificial Sequence
  Synthetic
DIQMTQSPSSLSASVGDRVTITCRASQSVSSFLNWYQQKPGKAPKLLIYAASSLQSGVPSRFSGSGSGTDFTLTISSLQPEDFATYYCQQSYIIPGTFGQGTKLEI

SEQ ID NO: 5457 - protein, 9 aa, Artificial Sequence
  Synthetic
QQSYIIPGT

SEQ ID NO: 5458 - protein, 115 aa, Artificial Sequence
  Synthetic
EVQLVESGGGLVQPGGSLRLSCAASGLTVSSNYMNWVRQAPGKGLEWVSVIYSGGSTFYADSVKGRFMISRDNSKNTLYLQMNSLRAEDTAVYYCARESYGMDVWGQGTTVTVSS

SEQ ID NO: 5459 - protein, 9 aa, Artificial Sequence
  Synthetic
ARESYGMDV

SEQ ID NO: 5460 - protein, 109 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPRDTFGQGTKLEIK

SEQ ID NO: 5461 - protein, 11 aa, Artificial Sequence
  Synthetic
QQLNSYPPRDT

SEQ ID NO: 5462 - protein, 123 aa, Artificial Sequence
  Synthetic
QVQLVESGGGVVQPGRSLRLSCAASGFTFSSYAMHWVRQAPGKGLEWVAVILDDGSNKHYADSVKGRFTISRDNSKTLYLQMNSLRAEDTAVYYCARDTTQQQLVLVSWFDSWGQGTLVTVSS

SEQ ID NO: 5463 - protein, 17 aa, Artificial Sequence
  Synthetic
ARDTTQQQLVLVSWFDS

SEQ ID NO: 5464 - protein, 108 aa, Artificial Sequence; identical to SEQ ID NO: 142
  Synthetic

SEQ ID NO: 5465 - protein, 10 aa, Artificial Sequence
  Synthetic
QQSYSTPPWT

SEQ ID NO: 5466 - protein, 121 aa, Artificial Sequence
  Synthetic
QVQLVESGGGVVQPGRSLRLSCAAYGFSFSTHTLHWVRQAPGKGLEWVAVISYDGSIKYSADSVKGRFTISRDNSKNTLYLQMNSLRAEDTAVYYCARDHPDTVYDLPDYWGQGTLVTVSS

SEQ ID NO: 5467 - protein, 14 aa, Artificial Sequence
  Synthetic
ARDHPDTVYDLPDY

SEQ ID NO: 5468 - protein, 108 aa, Artificial Sequence
  Synthetic
DIQMTQSPSSLSASVGDRVTITCRASQSISSYLNWYQQKPGKAPKLLIYAAYSLQSGVPSRFSGSGSGTDFTLTISSLQPEDFATYYCQQSYSNPPITFGPGTKVDIK

SEQ ID NO: 5469 - protein, 10 aa, Artificial Sequence
  Synthetic
QQSYSNPPIT

SEQ ID NO: 5470 - protein, 117 aa, Artificial Sequence
  Synthetic
EVQLVETGGGLIQPGGSLRLSCAASGIIVSSNYMSWVRQAPGKGLEWVSVIYSGGSTFYADSVKGRFTISRDNSKYTLYLQMNSLRAEDTAVYYCARDRGNDAFDIWGQGTMVTVSS

SEQ ID NO: 5471 - protein, 11 aa, Artificial Sequence
  Synthetic
ARDRGNDAFDI

SEQ ID NO: 5472 - protein, 109 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPSVTFGGGTKVEIK

SEQ ID NO: 5473 - protein, 11 aa, Artificial Sequence
  Synthetic
QQLNSYPPSVT

SEQ ID NO: 5474 - protein, 123 aa, Artificial Sequence
  Synthetic
QVQLQESGPGLVKPSETLSLTCTVSDGSISSYSWSWIRQPPGKGLEWIGYIYYSGSTSYNPSLKSRVTVSVDTSKNQFLKKSSVTAADTAVYYCARLDCSTTNCYFGGGMDVWGQGTTVTVSS

SEQ ID NO: 5475 - protein, 18 aa, Artificial Sequence
  Synthetic
ARLDCSTTNCYFGGGMDV

SEQ ID NO: 5476 - protein, 107 aa, Artificial Sequence
  Synthetic
DIQMTQSPSSLSASVGDRVTITCRPSQSINSYLNWYQQKPGKAPKLLIYAASSLQSGVPSRFSGSGYGTDFTLTISSLQPEDFATYYCQQSYSTPFTFGPGTKVDIK

SEQ ID NO: 5477 - protein, 9 aa, Artificial Sequence
  Synthetic
QQSYSTPFT

SEQ ID NO: 5478 - protein, 118 aa, Artificial Sequence
  Synthetic
EVQLVESGGGLVQPGGSLRLSCSASGFTFSRYAMNWVRQAPGKGLEYVSGINEGIRDYADSVKGRFTISRDNSKNTLYLQMSSLRAEDTAVYYCVKDTVGPTTLFDYWGQGTLVTVSS

SEQ ID NO: 5479 - protein, 13 aa, Artificial Sequence
  Synthetic
VKDTVGPTTLFDY

SEQ ID NO: 5480 - protein, 106 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPTFGGGTKVEIK

SEQ ID NO: 5481 - protein, 8 aa, Artificial Sequence
  Synthetic
QQSYSTPT

SEQ ID NO: 5482 - protein, 123 aa, Artificial Sequence
  Synthetic
EVQLVESGGGLVQPGGSLRLSCAASGFIVSSNYMRWVRQAPGKGLEWVSVIYSGGSTFYADSVKGRFTISRDNSKNTLYLQMNSLRAEDTAVYYCARDVGTMVRGYYYGMDVWGQGTTVTVSS

SEQ ID NO: 5483 - protein, 17 aa, Artificial Sequence
  Synthetic
ARDVGTMVRGYYYGMDV

SEQ ID NO: 5484 - protein, 107 aa, Artificial Sequence
  Synthetic
DIQMTQSPSTLSASVGDRVTITCRASQSISSWLAWYQQKPGKAPKLLIYKASSSEGGVPSRFSGSGSGTEFTLTISSLQPDDFATYYCQHYNTYSITFGQGTRLEIK

SEQ ID NO: 5485 - protein, 9 aa, Artificial Sequence
  Synthetic
QHYNTYSIT

SEQ ID NO: 5486 - protein, 127 aa, Artificial Sequence
  Synthetic
EVQLVESGGGLVQPGGSLRLSCAASGFTFSSYAKTWVRQAPGKGLEWVSGISGSGGSTYYADSVKGRFTISSDNSKNTLYLQMNSLRAEDTAVYYCAGRYCSSNTYSGCYYYGMDVWGQGTTVTVSS

SEQ ID NO: 5487 - protein, 20 aa, Artificial Sequence
  Synthetic
AGRYCSSNTYSGCYYYGMDV

SEQ ID NO: 5488 - protein, 107 aa, Artificial Sequence
  Synthetic
DIQMTQSPSSLSASVGDRVTITCRASQSISSFLNWYQQKPGKAPKLLIYAASSLQSGVPSRFSGSGSGTDFTLTISSLQPEDFATYFCQQSYITPQTFGQGTNVEIK

SEQ ID NO: 5489 - protein, 9 aa, Artificial Sequence
  Synthetic
QQSYITPQT

SEQ ID NO: 5490 - protein, 123 aa, Artificial Sequence
  Synthetic
QVQLVQSGAEVKKPGSSVKVSCKASGGTFSSYAISWVRQAPGQGLEWMGRIIPFHDIANYAQKFQGRVTITADKSTSTAYMELSSLRSEDTAVYYCARASYYYDSSGYHFDYWGQGTLVTVSS

SEQ ID NO: 5491 - protein, 16 aa, Artificial Sequence
  Synthetic
ARASYYYDSSGYHFDY

SEQ ID NO: 5492 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYASSPRTFGGGTKVEIK

SEQ ID NO: 5493 - protein, 9 aa, Artificial Sequence
  Synthetic
QQYASSPRT

SEQ ID NO: 5494 - protein, 116 aa, Artificial Sequence
  Synthetic
EVQLVESGGGLVQPGGSLRLSCAASEFTVSSNYMNWVRQAPGKGLEWVSVIYSGGSTFYADSVKGRFTISRDNSKNTLYLQMNSLRVEDTAVYYCARELRGYFDYWGQGTLVTVSS

SEQ ID NO: 5495 - protein, 10 aa, Artificial Sequence
  Synthetic
ARELRGYFDY

SEQ ID NO: 5496 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQLNSYPMYTFGQGTKLEIK

SEQ ID NO: 5497 - protein, 10 aa, Artificial Sequence
  Synthetic
QQLNSYPMYT

SEQ ID NO: 5498 - protein, 121 aa, Artificial Sequence
  Synthetic
QVQLQESGPRLVKPSETLSLTCSVSGGSISSFFWSWIRQPAGKGLEWIGRISTSGSTNYNPSLKSRVTMSVDTSKNLFSLKLNSVTAADTAVYYCARESPYSSSPSGFDYWGQGTLVTVSS

SEQ ID NO: 5499 - protein, 15 aa, Artificial Sequence
  Synthetic
ARESPYSSSPSGFDY

SEQ ID NO: 5500 - protein, 108 aa, Artificial Sequence
  Synthetic
EIVMTQSPATLSVSPGERATLSCRASQSVSSNLAWYQQKPGQAPRLLIYGASTRATGVPARFSGSGSGTEFTLTISSLQSEDFAVYSCQQYSDWLTYTFGQGTKLEIK

SEQ ID NO: 5501 - protein, 10 aa, Artificial Sequence
  Synthetic
QQYSDWLTYT

SEQ ID NO: 5502 - protein, 121 aa, Artificial Sequence
  Synthetic
QVQLVESGGGVVQPGRSLRLSCAASGFTFSSYAIHWVRQAPGKGLEWVAVISYDGSFKYCADSVKGRFTISRDNSKNTLYLQMNSLRAEDTAVYYCARESNHMVTVVFDYWGQGTLVTVSS

SEQ ID NO: 5503 - protein, 14 aa, Artificial Sequence
  Synthetic
ARESNHMVTVVFDY

SEQ ID NO: 5504 - protein, 108 aa, Artificial Sequence
  Synthetic
DIQMTQSPSSLSASVGDRVTITCRASQTISSYLNWYQQKPGKAPKLLIYAASSLQSGVPSRFSGSGSGTDFTLTISSLQPEDFGTYYCQQSYSTLENTFGQGTKLEIK

SEQ ID NO: 5505 - protein, 10 aa, Artificial Sequence
  Synthetic
QQSYSTLENT

SEQ ID NO: 5506 - protein, 125 aa, Artificial Sequence
  Synthetic
QVQLQESGPGLVKPSETLSLTCTVSGGSISSYYWSWIRQPPGKGLEWIAYISYSGSANYNPSLRSRVTISVDTSKNQFSLKLSSVTAADTAVYYCARDNCGGDCYPDSYYGMDVWSQGTTVTVSS

SEQ ID NO: 5507 - protein, 19 aa, Artificial Sequence
  Synthetic
ARDNCGGDCYPDSYYGMDV

SEQ ID NO: 5508 - protein, 107 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYSWTFGQGTKVEIK

SEQ ID NO: 5509 - protein, 9 aa, Artificial Sequence
  Synthetic
QQYNSYSWT

SEQ ID NO: 5510 - protein, 123 aa, Artificial Sequence
  Synthetic
EVQLVESGGGLVQPGGSLRLSCSASGFTFSSYAMHWVRQAPGKGLEYVSSISSNGGSTYYADSVKGRFTISRDNSKNTLYLQMSSLRAEDTAVYYCVKDKEADKAMYVLFDYWGQGTLVTVSS

SEQ ID NO: 5511 - protein, 16 aa, Artificial Sequence
  Synthetic
VKDKEADKAMYVLFDY

SEQ ID NO: 5512 - protein, 107 aa, Artificial Sequence
  Synthetic
DIQMTQSPSSLSASVGDRVSITCRASQSISSYLNWYQQKPGKAPKLLIYAASSLQSGVPSRFSGSGSGTEFTLTISSLQPEDFATYYCQQSYSTSYTFGQGTKLEIK

SEQ ID NO: 5513 - protein, 9 aa, Artificial Sequence
  Synthetic
QQSYSTSYT

SEQ ID NO: 5514 - protein, 123 aa, Artificial Sequence
  Synthetic
QVQLVESGGGVVQPGRSLRLSCAASGFTFSAFAMHWVRQAPGQGLEWVAVILYDGSNKLYADSVKGRFTISRDNSKNTLYLQMNSLRAEDTAVYYCARDSSSQQHLVSWFDPWGQGTLVTVSS

SEQ ID NO: 5515 - protein, 16 aa, Artificial Sequence
  Synthetic
ARDSSSQQHLVSWFDP

SEQ ID NO: 5516 - protein, 108 aa, Artificial Sequence
  Synthetic
DIQMTQSPSSLSASVGDRVTITCRASQSISSYLNWYQQKPGKAPKLLIYVASSLQSGVPSRFSGSGSGTDFTLTISSLQPEDFATYYCQQSYSTPPWTFGQGTKVEIK

SEQ ID NO: 5517 - protein, 10 aa, Artificial Sequence
  Synthetic
QQSYSTPPWT

SEQ ID NO: 5518 - protein, 125 aa, Artificial Sequence
  Synthetic
EVQLVQSGAEVKKPGESLRISCKGSGYSFTTYWIDWVRQMPGKGLEWMGRIDPSDSYTNYSPSFQGHVTISADKSISTAYLQWSSLKASDTAMYYCARQEYYDSSGYQGDAFDIWGQGTMVTVSS

SEQ ID NO: 5519 - protein, 18 aa, Artificial Sequence
  Synthetic
ARQEYYDSSGYQGDAFDI

SEQ ID NO: 5520 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPWTFGQGTKVEIK

SEQ ID NO: 5521 - protein, 9 aa, Artificial Sequence
  Synthetic
QQSYSTPWT

SEQ ID NO: 5522 - protein, 117 aa, Artificial Sequence
  Synthetic
EVQLVESGGGLVQPGGSLRLSCAASGVTVSSNYMTWVRQAPGKGLEWVSVIYPGGSTFYADSVKGRFTISRHNSKNTLYLQMNSLRDEDTAVYYCARDLGEDAMDVWGQGTTVTVSS

SEQ ID NO: 5523 - protein, 11 aa, Artificial Sequence
  Synthetic
ARDLGEDAMDV

SEQ ID NO: 5524 - protein, 108 aa, Artificial Sequence
  Synthetic
DIQLTQSPSFLSASVGDRVTITCRASQGISSYLAWYQQKPGKAPKLLIYAASSLQSGVPSRFSGSGSGTEFTLTISSLQPEDFATYYCQQLNSYPPYTFGQGTKLEIK

SEQ ID NO: 5525 - protein, 10 aa, Artificial Sequence
  Synthetic
QQLNSYPPYT

SEQ ID NO: 5526 - protein, 121 aa, Artificial Sequence
  Synthetic
EVQLVESGGGLVKPGGSLRLSCAASGFAFSHAWMNWVRQAPGKGLEWVGRIKSKTDGGTTDYAAPVKGRFTISRDDSKNTLFLQMNSLKAEDTAVYYCTTDGAWTWSPDYWGQGTLVTVSS

SEQ ID NO: 5527 - protein, 12 aa, Artificial Sequence
  Synthetic
TTDGAWTWSPDY

SEQ ID NO: 5528 - protein, 107 aa, Artificial Sequence
  Synthetic
DIQMTQSPSSLSASVGDRVTITCRASQSISRYLNWYQQKPGKAPKLLIYAASSLQSGVPSRFSGSGSGTDFTLTISSLQPEDFATYYCRQSYSTLFTFGPGTKVDIK

SEQ ID NO: 5529 - protein, 9 aa, Artificial Sequence
  Synthetic
RQSYSTLFT

SEQ ID NO: 5530 - protein, 124 aa, Artificial Sequence
  Synthetic
EVQLLESGGGLVQPGGSLRLSCAASGFTFSSYAMSWVRQAPGKGLEWVSAISGSGGITDYADSVKGRFTISRDNSKNTLYLQMNSLRAEDTAVYYCAKDLGEQQLVVVDWFDPWGQGTLVTVSS

SEQ ID NO: 5531 - protein, 17 aa, Artificial Sequence
  Synthetic
AKDLGEQQLVVVDWFDP

SEQ ID NO: 5532 - protein, 107 aa, Artificial Sequence
  Synthetic
DIQMTQSPSSLSASVGDRVTITCRASQIISGYLNWYQQKPGKAPKLLIYAASSLQSGVPSRFSGSGSGTDFTLTISSLQPEDFATYYCQQSYSTPPTFGGGTKVEIK

SEQ ID NO: 5533 - protein, 9 aa, Artificial Sequence
  Synthetic
QQSYSTPPT

SEQ ID NO: 5534 - protein, 135 aa, Artificial Sequence
  Synthetic
QVQLVQSGAEVKKPGSSVTVSCKASGGTFSSYTISWVRQAPGQGLEWMGRIIPILGVTNYAQNFQGRVTFTADKSTSTAYMELRSLRSEDTAVYYCARSQGSHYDFWSTYQGPEGGEYYYFMDVWGKGTTVTVSS

SEQ ID NO: 5535 - protein, 28 aa, Artificial Sequence
  Synthetic
ARSQGSHYDFWSTYQGPEGGEYYYFMDV

SEQ ID NO: 5536 - protein, 111 aa, Artificial Sequence
  Synthetic
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGLYVFGTGTKVTVL

SEQ ID NO: 5537 - protein, 12 aa, Artificial Sequence
  Synthetic
AAWDDSLNGLYV

SEQ ID NO: 5538 - protein, 128 aa, Artificial Sequence
  Synthetic
EVQLVESGGGLVKPGGSLRLSCAASGFTFSRYSMNWVRQSPGKGLEWVSSIRSSSTDIYYADSVRGRFTISRDNAKNSLYLQMNSLRAEDTAVYYCARAFPGDYASDDYYYYYGMDVWGQGTTVIVSS

SEQ ID NO: 5539 - protein, 21 aa, Artificial Sequence
  Synthetic
ARAFPGDYASDDYYYYYGMDV

SEQ ID NO: 5540 - protein, 108 aa, Artificial Sequence
  Synthetic
SYVLTQPPSVSVSPGQTASITCSGHKLGDKYACWYQQKPGQSPVLLIYQDSKRPSGISERFSGSNSGNTATLTISGTQAMDEADYFCQAWDSTTAWGVFGGGTKLTVL

SEQ ID NO: 5541 - protein, 11 aa, Artificial Sequence
  Synthetic
QAWDSTTAWGV

SEQ ID NO: 5542 - protein, 124 aa, Artificial Sequence
  Synthetic
QVQLVQSGAEVKKPGSSVKVSCKASGGTFSSYSISWVRQAPGQGLEWMGRIIPILGIASYAQKFQGRVTITADKSTSTVYMELTGLRSDDTAVYYCARDRGYSDYGSHYYMDVWGKGTTATVSS

SEQ ID NO: 5543 - protein, 17 aa, Artificial Sequence
  Synthetic
ARDRGYSDYGSHYYMDV

SEQ ID NO: 5544 - protein, 111 aa, Artificial Sequence
  Synthetic
QSVLTQPPSVSGAPGQRVTISCTGSSSNIGAGYDVHWYQQLPGTAPKLLIYINSNRPSGVPDRFSGSKSGTSASLAITGLQAEDEADYYCQSYDSSLSDSVFGGGTKLTVL

SEQ ID NO: 5545 - protein, 11 aa, Artificial Sequence
  Synthetic
QSYDSSLSDSV

SEQ ID NO: 5546 - protein, 126 aa, Artificial Sequence
  Synthetic
EVQLVESGGGLVQPGRSLRLSCAASGFTFDDYAMHWVRQGPGKGLEWVSGVTWNSGTIGYADSVKGRFIISRDNAKNSLYLQMTSLRAEDTALYYCAKDKYGSGSYRDYYYGLDVWGQGTTVTVSS

SEQ ID NO: 5547 - protein, 19 aa, Artificial Sequence
  Synthetic
AKDKYGSGSYRDYYYGLDV

SEQ ID NO: 5548 - protein, 108 aa, Artificial Sequence
  Synthetic
SYVLTQLPSVSVAPGQTARISCGGNNIGSKSVHWYHQKPGQAPLLVVYDDNDRPSGIPERFSGSNSGSTATLTISRVEAGDEADYYCQVWDSSSDVVIFGGGTKLTVL

SEQ ID NO: 5549 - protein, 11 aa, Artificial Sequence
  Synthetic
QVWDSSSDVVI

SEQ ID NO: 5550 - protein, 124 aa, Artificial Sequence
  Synthetic
QVQLVQSGAEVKKSGSSVKVSCKASGGTFSSYPISWVRQAPGQGLEWMGRIIPFLGAADYAQKFQGRVTITADKSTSTAYMELNSLTSEDTALYYCARDRGYSGYGAHYYTDVWGKGTTVTVSS

SEQ ID NO: 5551 - protein, 17 aa, Artificial Sequence
  Synthetic
ARDRGYSGYGAHYYTDV

SEQ ID NO: 5552 - protein, 111 aa, Artificial Sequence
  Synthetic
QSVLTQPPSVSGAPGQRVTISCTGSSSNIGAGYDVHWYQQVPGTAPKLLIYRNTNRPSGVPDRFSGSKSGTSASLAITGLQAEDEADYYCQSHDSSLSGSVFGGGTKLTVL

SEQ ID NO: 5553 - protein, 11 aa, Artificial Sequence
  Synthetic
QSHDSSLSGSV

SEQ ID NO: 5554 - protein, 128 aa, Artificial Sequence
  Synthetic
QVQLVESGGGVVQPGRSLRLSCAASGFTFSNYAMHWVRQAPGKGLEWVAVISYEGTNKHHAHSVKGRFTISRDNSRNTLYLQMNSLRVDDTAVYYCASEGVGSSTNIAAAGTGYFVYWGQGTLVTVSS

SEQ ID NO: 5555 - protein, 21 aa, Artificial Sequence
  Synthetic
ASEGVGSSTNIAAAGTGYFVY

SEQ ID NO: 5556 - protein, 108 aa, Artificial Sequence
  Synthetic
SYVLTQPPSVSVAPGQTARITCGGNNIGSKSVHWYQQKPGQAPVLVVYDDTDRPSGIPERFSGSNSGNTATLTISRVEAGDEADYYCQVWDSTGDHWFFGGGTKLTVL

SEQ ID NO: 5557 - protein, 11 aa, Artificial Sequence
  Synthetic
QVWDSTGDHWF

SEQ ID NO: 5558 - protein, 127 aa, Artificial Sequence
  Synthetic
QVQLVESGGGVVQPGRSLRLSCAVSGFTLSRYGMHWVRQAPGKGLEWVAVIPYDGSNKYYGDSVKGRFSISRDNSKNTLYLQMNSLRAEDTAVYYCAKTSMPYCGGGNCYSLVVDYWGQGTLVTVSS

SEQ ID NO: 5559 - protein, 20 aa, Artificial Sequence
  Synthetic
AKTSMPYCGGGNCYSLVVDY

SEQ ID NO: 5560 - protein, 111 aa, Artificial Sequence
  Synthetic
NFVLTQPHSVSESPGKTVTISCTRSSGSIASNYVQWYQQRPGSAPTTVIYEDNHKPSGVPDRFSGSIDSSSNSASLTISGLKTEDEADYYCQSYDSSNHGVFGGGTKLTVL

SEQ ID NO: 5561 - protein, 10 aa, Artificial Sequence
  Synthetic
QSYDSSNHGV

SEQ ID NO: 5562 - protein, 125 aa, Artificial Sequence
  Synthetic
QVQLVQSGAEVKKPGSSVKVSCKASGGTFSSYTISWVRQAPGQGLDWMGRIIPILGIANYAQKFQGRVTITADKSTSTAYMELSSLRSEDTAVYYCARDNVEGYNSSSIYWFDPWGQGTLVTVSS

SEQ ID NO: 5563 - protein, 18 aa, Artificial Sequence
  Synthetic
ARDNVEGYNSSSIYWFDP

SEQ ID NO: 5564 - protein, 111 aa, Artificial Sequence
  Synthetic
QSVLTQPPSVSGAPGQRVTISCTGSSSNIGAGYDVHWYQQLPGTAPKLLIYDNSNRPSGVPDRFSGSKSGTSASLAITGLQAEDEADYYCQSYDSSLSDYVFGPGTKVTVL

SEQ ID NO: 5565 - protein, 11 aa, Artificial Sequence
  Synthetic
QSYDSSLSDYV

SEQ ID NO: 5566 - protein, 125 aa, Artificial Sequence
  Synthetic
QVQLQQWGAGLLKPSETLSLTCAVYGGSFSGYYWNWIRQPPGKGLEWIGEINHSGSTNYNPSLKSRVTISVDTSKKQFSLKLSSVTAADTAVYYCARATYYYDSSGYGINWFDPWGQGTLVTVSS

SEQ ID NO: 5567 - protein, 19 aa, Artificial Sequence
  Synthetic
ARATYYYDSSGYGINWFDP

SEQ ID NO: 5568 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSAYVFGGGTKLTVL

SEQ ID NO: 5569 - protein, 11 aa, Artificial Sequence
  Synthetic
QSYDSSLSAYV

SEQ ID NO: 5570 - protein, 120 aa, Artificial Sequence
  Synthetic
QVQLVQSGAEVKKPGASVKVSCKASGYTFTTYSMNWVRQAPGQGLDWMGIIYPSGGSTSKAQKFQGRVTMTRDTSTSTVYMELSSLRSEDTAVYYCARASLTGTDAFDIWGQGTMVTVSS

SEQ ID NO: 5571 - protein, 13 aa, Artificial Sequence
  Synthetic
ARASLTGTDAFDI

SEQ ID NO: 5572 - protein, 106 aa, Artificial Sequence
  Synthetic
SYVLTQPPSVSVAPGKTARITCGGDNIGSKSVHWYQQKPGQAPVLVIYYDSDRPSGIPERFSGSNSGNTATLTISRVEAGDEADYSCQVWDSSSVLFGGGTKLTVL

SEQ ID NO: 5573 - protein, 9 aa, Artificial Sequence
  Synthetic
QVWDSSSVL

SEQ ID NO: 5574 - protein, 120 aa, Artificial Sequence
  Synthetic
QVQLQESGPGLVKPSETLSLTCTVSGGSISSYYWSWIRQPAGKGLECIGRIYTSGSTNYNPSLKSRVTMSVDTSKNQFSLKLSSVTAADTAVYYCARVNAFWSSYYFDYWGQGTLVTVSS

SEQ ID NO: 5575 - protein, 14 aa, Artificial Sequence
  Synthetic
ARVNAFWSSYYFDY

SEQ ID NO: 5576 - protein, 108 aa, Artificial Sequence
  Synthetic
SYVLTQPPSVSVAPGQTARITCGGNNIGSKSVHWYQQKPGQAPVLVVYDDSDRPSGIPERFSGSNSGNTATLTISRVEAGDEADYYCQVWDISSDHPVFGGGTKLTVL

SEQ ID NO: 5577 - protein, 11 aa, Artificial Sequence
  Synthetic
QVWDISSDHPV

SEQ ID NO: 5578 - protein, 119 aa, Artificial Sequence
  Synthetic
QVQLVQSGAEVKKPGASVKVSCKASGYTFTSYGINWVRRAPGQGLEWMGWISTYNGNTNYAQKLQDRVTMTTDTSTSTAYMELRSLRSDDTAVYYCARGLAAILGADYWGQGTLVTVSS

SEQ ID NO: 5579 - protein, 12 aa, Artificial Sequence
  Synthetic
ARGLAAILGADY

SEQ ID NO: 5580 - protein, 110 aa, Artificial Sequence
  Synthetic
NFMLTQPHSVSESPGKTITISCTRSSGSIGSNYVQWYQQRPGSAPTTIIYEDNQRPSGVPDRFSGSIDSSSNSASLTISGLKTEDEADYYCQSYESTHQVFGGGTKLTVL

SEQ ID NO: 5581 - protein, 9 aa, Artificial Sequence
  Synthetic
QSYESTHQV

SEQ ID NO: 5582 - protein, 128 aa, Artificial Sequence
  Synthetic
QVQLVQSGAEVKKPGSSVKVSCTASGGTFSSYSITWVRQAPGQGLEWMGRIIPSFGTASYAQKFQGRVTITADESTSTASMELSSLRSEDTAVYYCATGGVHIVVVPTYHNYYGLDVWGQGTTVTVSS

SEQ ID NO: 5583 - protein, 21 aa, Artificial Sequence
  Synthetic
ATGGVHIVVVPTYHNYYGLDV

SEQ ID NO: 5584 - protein, 110 aa, Artificial Sequence
  Synthetic
QSVLTQPRSVSGSPGQSVTISCTGTSSDVGGYDYVSWYQQHPGKAPKLMIYDVTKRPSGVPDRFSGSKSGNTASLTISGLQAEDEADYYCCSYAGSYTHVFGTGTKVTVL

SEQ ID NO: 5585 - protein, 10 aa, Artificial Sequence
  Synthetic
CSYAGSYTHV

SEQ ID NO: 5586 - protein, 125 aa, Artificial Sequence
  Synthetic
QVQLQQWGAGLLKPSETLALTCAVYGGSFSRYYWSWIRQPPGKGLEWIGEINHSGSTNYNPSLKSRVTISIDTSKNQFSLKLSSVTAADTAVYYCATTTYYYDSSAYGINWFDPWGQGSLVTVSS

SEQ ID NO: 5587 - protein, 19 aa, Artificial Sequence
  Synthetic
ATTTYYYDSSAYGINWFDP

SEQ ID NO: 5588 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDTNMSGYVFGGGTKLTVL

SEQ ID NO: 5589 - protein, 11 aa, Artificial Sequence
  Synthetic
QSYDTNMSGYV

SEQ ID NO: 5590 - protein, 96 aa, Artificial Sequence
  Synthetic
EVQLVESGGGLIQPGGSLRLSCAASGFTVSRNYMSWVRQAPGKGLEWVSVIYTGGSTYYADSVKGRFTISRDNSKNTLYLQMNSLHQGPIGLPPGT

SEQ ID NO: 5591 - skipped

SEQ ID NO: 5592 - protein, 111 aa, Artificial Sequence
  Synthetic
QSVLTQPPSVSGAPGQRVTISCTGSNSNIGAGYDVHWYQQLPGTAPKLLIYGNSNRPSGVPDRFSGSKSGTSASLAITGLQAEDEADYYCQSYDSSLSDYVFGTGTKVTVL

SEQ ID NO: 5593 - protein, 11 aa, Artificial Sequence
  Synthetic
QSYDSSLSDYV

SEQ ID NO: 5594 - protein, 118 aa, Artificial Sequence
  Synthetic
EVQLLESGGGLVQPGGSLRLSCAASGFTFSSFAMTWVRQAPGKGLEWVSTISSSGGSTYYADSVKGRFTISRDNSKNTLYLQMNSLRAEDTAVYYCAKYVDTTMVDQWGQGTLVTVSS

SEQ ID NO: 5595 - protein, 11 aa, Artificial Sequence
  Synthetic
AKYVDTTMVDQ

SEQ ID NO: 5596 - protein, 110 aa, Artificial Sequence
  Synthetic
SYVLTQPPSVSVAPGKTARITCGGNNIGSKSVHWYQQKPGQAPVLVIYYDSDRPSGIPERFSGSNSGNTATLTISRVEAGDEADYYCQVWDRTSDHPGLVFGTGTKVTVL

SEQ ID NO: 5597 - protein, 13 aa, Artificial Sequence
  Synthetic
QVWDRTSDHPGLV

SEQ ID NO: 5598 - protein, 122 aa, Artificial Sequence
  Synthetic
EVQLVESGGGLVQPGRSLRLSCAASGFTFDDYAMHWVRQVPGKGLEWVSGTSWNSGTIGYGDSVKGRFIISRDNAKNSLYLQMNSLRAEDTALYYCVKDIGLRDKWNGFDYWGQGTLVTVSS

SEQ ID NO: 5599 - protein, 15 aa, Artificial Sequence
  Synthetic
VKDIGLRDKWNGFDY

SEQ ID NO: 5600 - protein, 108 aa, Artificial Sequence
  Synthetic
SYVLTQPPSVSVAPGKTARITCGGNNIGSKSVHWYQQKPGQAPVLVISYDSDWPSGIPERFSGSNSGNTATLTISRVEAGDEADYFCQVWDSTGDHAVFGGGTKLTVL

SEQ ID NO: 5601 - protein, 11 aa, Artificial Sequence
  Synthetic
QVWDSTGDHAV

SEQ ID NO: 5602 - protein, 119 aa, Artificial Sequence
  Synthetic
EVQLVESGGGLVQPGGSLRLSCAASGFTFSSYWMHWVRQAPGKGLVWVSRINSDGITTSYADSVKGRFTISRDNAKNTLYLQMNSLRAEDTAVYYCARALRPPTNMDVWGQGTTVTVSS

SEQ ID NO: 5603 - protein, 12 aa, Artificial Sequence
  Synthetic
ARALRPPTNMDV

SEQ ID NO: 5604 - protein, 110 aa, Artificial Sequence
  Synthetic
QSVLTQPPSVSEAPRQRVTISCSGSSSNIGNNAVNWYQQLPGKAPKIIIYFDDLLPSGVSDRFSGSKSGTSASLAISGLQSEDEADYYCAAWDDSLNGVVFGGGTKLTVL

SEQ ID NO: 5605 - protein, 11 aa, Artificial Sequence
  Synthetic
AAWDDSLNGVV

SEQ ID NO: 5606 - protein, 125 aa, Artificial Sequence
  Synthetic
QVQLQQWGAGLLKPSETLSLTCAVYGGSFSGYYWNWIRQPPGKGLEWIGEINHSGSTTYNPSLKSRVTISVDTSKNQFSLKLSSVTAADTAVYYCARATYYFDSSGYGINWFDPWGQGTLVTVSS

SEQ ID NO: 5607 - protein, 19 aa, Artificial Sequence
  Synthetic
ARATYYFDSSGYGINWFDP

SEQ ID NO: 5608 - protein, 111 aa, Artificial Sequence
  Synthetic
QSVLTQPPSVSGAPGQRVTISCTGSSSNIGAGYDVHWYQQLPGTAPKLLIYANSYRPSGVPDRCSGSKSGTSASLAITGLQAEDEADYYCQSYDVSLSAYVFGGGTKLTVL

SEQ ID NO: 5609 - protein, 11 aa, Artificial Sequence
  Synthetic
QSYDVSLSAYV

SEQ ID NO: 5610 - protein, 120 aa, Artificial Sequence
  Synthetic
QVQLVQSGAEVKKPGASVKVSCKASGFTLTSYGISWVRQAPGQGLEWMGWISAYHGNTNYVQKLQGRVTMTTDTSTSTAYMELRSLRSDDTAVYYCARTVGVPSDHFDYWGQGTLVTVSS

SEQ ID NO: 5611 - protein, 13 aa, Artificial Sequence
  Synthetic
ARTVGVPSDHFDY

SEQ ID NO: 5612 - protein, 109 aa, Artificial Sequence
  Synthetic
SYVLTQPPSVSVAPGQTARISCEGNNIGSKNVHWYQQRPGQAPVLVVFDDSDRPSGIPERFSGSNSGNTATLTISRVEAGDEADYYCQVWDSSSDHFWVFGGGTKLTVL

SEQ ID NO: 5613 - protein, 12 aa, Artificial Sequence
  Synthetic
QVWDSSSDHFWV

SEQ ID NO: 5614 - protein, 122 aa, Artificial Sequence
  Synthetic
QVQLVQSGAEVKKPGSSVKVSCKASGGTFGSNSISWVRQAPGQGLEWMGRIIPILGIANYAHKFQGRVTITADKSTSTAYMELSSLRSEDTAVYYCATEAQYCRSTTCYGGYWGQGTLVTVS

SEQ ID NO: 5615 - protein, 16 aa, Artificial Sequence
  Synthetic
ATEAQYCRSTTCYGGY

SEQ ID NO: 5616 - protein, 111 aa, Artificial Sequence
  Synthetic
QSVLTQPPSVSGAPGQRVTFSCTGSSSNIGAGYDVHWYQQLPGTAPKLLIYNNSNRPSGVPARFSGSKSDTSASLAITGLQAEDEADYYCQSYDSSLSGVVFGGGTKLTVL

SEQ ID NO: 5617 - protein, 11 aa, Artificial Sequence
  Synthetic
QSYDSSLSGVV

SEQ ID NO: 5618 - protein, 127 aa, Artificial Sequence
  Synthetic
EVQLVESGGGLVKPGRSLRLSCTASGFTFGDYAMSWFRQAPGKGLEWVGFIRIKAYGGTTEYAASVKGRFTISRDDSKSIAYLQMNSLKTEDTAVYYCTRVVDILTGYYYPDAFDIWGQGTMVTVSS

SEQ ID NO: 5619 - protein, 18 aa, Artificial Sequence
  Synthetic
TRVVDILTGYYYPDAFDI

SEQ ID NO: 5620 - protein, 110 aa, Artificial Sequence
  Synthetic
QSVLTQPPSASGTPGQRVTISCSGSSSNIGSYTVNWYQQLPGTAPKLLIYSNNQRPSGVPDRFSGSKSGTSASLAISGLQSEDEADYYCAAWDDSLNGAVFGGGTQLTVL

SEQ ID NO: 5621 - protein, 11 aa, Artificial Sequence
  Synthetic
AAWDDSLNGAV

SEQ ID NO: 5622 - protein, 128 aa, Artificial Sequence
  Synthetic
QVQLVQSGAEVKKPGSSVKVSCKASGGTFSSYTIAWVRQAPGQGLEWMGRIIPILDIANYAQNFQGRVTITADKSTSTAYMELSGLRSEDTAVYFCARDKASYCSNTSCLSTYYMDVWGKGTTVTVSS

SEQ ID NO: 5623 - protein, 21 aa, Artificial Sequence
  Synthetic
ARDKASYCSNTSCLSTYYMDV

SEQ ID NO: 5624 - protein, 111 aa, Artificial Sequence
  Synthetic
QFVLTQPPSVSGAPGQRVTISCTGSGSNIGAGYDVHWYQQLLGTAPKLLIYGNNNRPSGVPARFSGSKSGTSASLAITGLQPEDEADYYCHSYDSSLSYDVFGGGTKLTVL

SEQ ID NO: 5625 - protein, 10 aa, Artificial Sequence
  Synthetic
HSYDSSSYDV

SEQ ID NO: 5626 - protein, 122 aa, Artificial Sequence
  Synthetic
QLQLQESGPGLVKASETLSLTCTVSGGSITTSSYSWVWIRQSPGKGLECIGSISYSGSPYYNPSLKSRLTISADSSKNQFSLKLRSVTAADTAVYYCAREGVVPAANNWFDPWGQGTLVTVS

SEQ ID NO: 5627 - protein, 15 aa, Artificial Sequence
  Synthetic
AREGVVPAANNWFDP

SEQ ID NO: 5628 - protein, 109 aa, Artificial Sequence
  Synthetic
SYVLTQPPSVSVAPGQTARITCGGNNIGSKSVHWYQQRPGQAPVLVVYDDSDRPSGIPERFSGSNSGNTATLTISRVEAGDEADYYCQLWDGGSDHFYVFGTGTRVTVL

SEQ ID NO: 5629 - protein, 12 aa, Artificial Sequence
  Synthetic
QLWDGGSDHFYV

SEQ ID NO: 5630 - protein, 124 aa, Artificial Sequence
  Synthetic
QVQLQESGPGLVKPSETLSLTCTVSGGSINTFYWSWIRQPPGKGLEWIGHIYDSGSTKYSPSLKSRVTISVDTSKNQFSLKLTSVTAADTAVYYCAREGITMVQGVIHNWFDPWGQGTLVTVSS

SEQ ID NO: 5631 - protein, 18 aa, Artificial Sequence
  Synthetic
AREGITMVQGVIHNWFDP

SEQ ID NO: 5632 - protein, 110 aa, Artificial Sequence
  Synthetic
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVL

SEQ ID NO: 5633 - protein, 11 aa, Artificial Sequence
  Synthetic
AAWDDSLSGPV

SEQ ID NO: 5634 - protein, 122 aa, Artificial Sequence
  Synthetic
QVQLVQSGAEVKKPGSSVKVSCKASGGTFSSYSISWVRQAPGQGLEWMGRIIPILGIPNDAQKFQGRVTITADKSTSTAYMELSSLRSEDTAVYYCAREGFNCRSTSCYDSWGQGTLVTVSS

SEQ ID NO: 5635 - protein, 15 aa, Artificial Sequence
  Synthetic
AREGFNCRSTSCYDS

SEQ ID NO: 5636 - protein, 111 aa, Artificial Sequence
  Synthetic
QSVLTQPPSVSGAPGQRVTISCTGSNSNIGAGYDVHWYQQLPGTAPKLLIYDNTNRPSGVPARFSGSKSGTSASLAITGLQAEDEADYYCQSYDSSLIGSVFGGGTKLTVL

SEQ ID NO: 5637 - protein, 11 aa, Artificial Sequence
  Synthetic
QSYDSSLIGSV

SEQ ID NO: 5638 - protein, 124 aa, Artificial Sequence
  Synthetic
EVQLVESGGGLVQPGRSLRLSCAASGFTFDDYAMHWVRQAPGKGLEWVSGISWNSGYIGYADSVKGRFTISRDNAKNSLYLQMNSLRAEDTALYYCAKDMEYSGTDYYYGMDVWGQGTTVTVSS

SEQ ID NO: 5639 - protein, 17 aa, Artificial Sequence
  Synthetic
AKDMEYSGTDYYYGMDV

SEQ ID NO: 5640 - protein, 111 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 5641 - protein, 11 aa, Artificial Sequence
  Synthetic
QSYDSSLSGVV

SEQ ID NO: 5642 - protein, 128 aa, Artificial Sequence
  Synthetic
QVQLVQSGAEVKKPGSSVKVSCKASGGTFSSHAITWVRQAPGQGLEWMGRIIPSFGTTNYAQKFQGRVTITADESTSTASMELSSLRSEDTAVYYCATGGVHIVVVPTYHNYYGLDVWGQGTTVTVSS

SEQ ID NO: 5643 - protein, 21 aa, Artificial Sequence
  Synthetic
ATGGVHIVVVPTYHNYYGLDV

SEQ ID NO: 5644 - protein, 110 aa, Artificial Sequence
  Synthetic
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTHVFGTGTKVTVL

SEQ ID NO: 5645 - protein, 10 aa, Artificial Sequence
  Synthetic
CSYAGSYTHV

SEQ ID NO: 5646 - protein, 121 aa, Artificial Sequence
  Synthetic
QVQLVQSGAEVKKPGASVKVSCKASGYTFTSHYMYWVRQAPGQGLEWMGVINPSGGSTTYAQKFQGRVTMTKDTSTSTVYMELSSLRSEDTAVYYCARGQSVPAATHFDYWGQGTLVTVSS

SEQ ID NO: 5647 - protein, 14 aa, Artificial Sequence
  Synthetic
ARGQSVPAATHFDY

SEQ ID NO: 5648 - protein, 113 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNRGDWVFGGGTKLTVL

SEQ ID NO: 5649 - protein, 12 aa, Artificial Sequence
  Synthetic
QSYDSSNRGDWV

SEQ ID NO: 5650 - protein, 124 aa, Artificial Sequence
  Synthetic
QVQLVQSGAEVKKPGSSVKVSCKASGGTFSSYSISWVRQAPGQGLEWMGGIIPAFGIATYAQKFQGRVTITADESTSTAYMELSSLRSDDTAVFYCARDRGYGDSERTVFFDYWGQGTLVTVSS

SEQ ID NO: 5651 - protein, 17 aa, Artificial Sequence
  Synthetic
ARDRGYGDSERTVFFDY

SEQ ID NO: 5652 - protein, 110 aa, Artificial Sequence
  Synthetic
QSVLTQPASVSGSPGQSITISCTGTSSDVGSYNLVSWYQHHPGKAPKLMIYEGSQRPSGVSYRFSGSKSGNTASLTVSGLQAEDEADYYCCSYAGSNTWVFGGGTKLTVL

SEQ ID NO: 5653 - protein, 10 aa, Artificial Sequence
  Synthetic
CSYAGSNTWV

SEQ ID NO: 5654 - protein, 121 aa, Artificial Sequence
  Synthetic
QVQLQESGPGLVKPSGTLSLTCAVSGGSISSTNWWSWVRQPPGKGLEWIGEIYHSGSTNYNPSLKSRVTISLDKSKNQFSLRLSSVTAADTAIYFCARKVFTVTSPQFDYWGQGTLVTVSS

SEQ ID NO: 5655 - protein, 14 aa, Artificial Sequence
  Synthetic
ARKVFTVTSPQFDY

SEQ ID NO: 5656 - protein, 110 aa, Artificial Sequence
  Synthetic
QSALTQPRSVSGSPGQSVTISCTGTSSDVGSYNYVSWYQYHPGKAPKLMIYDVSERPSGVPDRFSGSKSGNTASLTISGLQAEDEADYYCCSYAATYTVVFGGGTKLTVL

SEQ ID NO: 5657 - protein, 10 aa, Artificial Sequence
  Synthetic
CSYAATYTVV

SEQ ID NO: 5658 - protein, 120 aa, Artificial Sequence
  Synthetic
EVQLVQSGAEVKKPGESLKISCKGFGYSFTSSWIAWVRQMPGKGLEWMGIIYPGDSDTRYSPSFQGRVTFSADKFISTAYLHWSSLKASDTAIYYCARTPSSQYNWFDPWGQGTLVTVSS

SEQ ID NO: 5659 - protein, 13 aa, Artificial Sequence
  Synthetic
ARTPSSQYNWFDP

SEQ ID NO: 5660 - protein, 110 aa, Artificial Sequence
  Synthetic
NFMLTQPHSVSESPGKTVTISCTGSSGSIASNYVQWYQLRPGSAPTTVIYEDNQRPSGVPDRFSGSIDSSSNSASLTISGLKTEDEADYYCQSYVNNNVVFGGGTKLTVL

SEQ ID NO: 5661 - protein, 9 aa, Artificial Sequence
  Synthetic
QSYVNNNVV

SEQ ID NO: 5662 - protein, 125 aa, Artificial Sequence
  Synthetic
EVQLVESGGTLVQPGRSLRLSCAASGFTFDDYAMHWVRQAPGKGLEWVSGVTWNSGTLGYADSVKGRFIISRDNAKNSLYLQMNRLRAEDTALYYCVKDIGFRDRMGPRYGMDVWGQGTTVTVSS

SEQ ID NO: 5663 - protein, 18 aa, Artificial Sequence
  Synthetic
VKDIGFRDRMGPRYGMDV

SEQ ID NO: 5664 - protein, 110 aa, Artificial Sequence
  Synthetic
QSVLTQPPSASGTPGQRVTISCSGSSSNIGSNYVYWYQQLPGTAPKLLIYRNNERPSGVPDRFSGSKSGTSASLAISGLRSEDEADYYCAAWDDSLSGPVFGGGTKLTVL

SEQ ID NO: 5665 - protein, 11 aa, Artificial Sequence
  Synthetic
AAWDDSLSGPV

SEQ ID NO: 5666 - protein, 133 aa, Artificial Sequence
  Synthetic
EVQLVQSGAEVKKPGESLKISCKGSGYGFTNYWIGWVRQMPGKGLEWMGIIYPADSDTRYSPSFQGQVTISADKSIRTAYLQWSSLKASDTAMYYCARPVPWGVGYDILTGYSALDSYYFDSWGQGTRVTVSS

SEQ ID NO: 5667 - protein, 26 aa, Artificial Sequence
  Synthetic
ARPVPWGVGYDILTGYSALDSYYFDS

SEQ ID NO: 5668 - protein, 111 aa, Artificial Sequence
  Synthetic
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHRVFGGGTKLTVL

SEQ ID NO: 5669 - protein, 10 aa, Artificial Sequence
  Synthetic
QSYDSSNHRV

SEQ ID NO: 5670 - protein, 125 aa, Artificial Sequence
  Synthetic
EVQLVESGGGLVQPGRSLRLSCAASGFTFDDYAMHWVRQAPGMGLEWVSGISWNSASVGYAASVRGRFTISRDNAKNSLYLQMNRLRAEDTALYYCAKVGMIDGVTTVTTFLDYWGQGTLVTVSS

SEQ ID NO: 5671 - protein, 18 aa, Artificial Sequence
  Synthetic
AKVGMIDGVTTVTTFLDY

SEQ ID NO: 5672 - protein, 107 aa, Artificial Sequence
  Synthetic
EIVMTQSPATLSVSPGGRATLSCRASQSVSSNLAWYQQKPGQAPRLLILGASSRATGIPARFSGSGSGTEFTLTISSLQSEDFAVYYCQQYNYWPPIFGPGTKVDIK

SEQ ID NO: 5673 - protein, 9 aa, Artificial Sequence
  Synthetic
QQYNYWPPI

SEQ ID NO: 5674 - protein, 116 aa, Artificial Sequence
  Synthetic
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARGEGLFDYWGQGTLVTVSS

SEQ ID NO: 5675 - protein, 9 aa, Artificial Sequence
  Synthetic
ARGEGLFDY

SEQ ID NO: 5676 - protein, 108 aa, Artificial Sequence
  Synthetic
DIQMTQSPSSLSASVGDRVTITCRASQGISNSLAWYQQKPGKAPKLLLYAASRLESGVPSRFSGSGSGTDYTLTISSLQPEDFATYYCQQYYSTLRRTFGQGTKVEIK

SEQ ID NO: 5677 - protein, 10 aa, Artificial Sequence
  Synthetic
QQYYSTLRRT

SEQ ID NO: 5678 - protein, 122 aa, Artificial Sequence
  Synthetic
QVQLVQSGAEVKKPGASVKVSCKASGYTFTSQYMHWVRQAPGQGLEWMGIINPSAGSTSYAQKFQGRLTMTSDTSTSTVYMDLSSLRSEDTAVYYCARDIVFVPAAMGLDYWGQGTLVTVSS

SEQ ID NO: 5679 - protein, 15 aa, Artificial Sequence
  Synthetic
ARDIVFVPAAMGLDY

SEQ ID NO: 5680 - protein, 107 aa, Artificial Sequence
  Synthetic
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPWTFGQGTKVEIK

SEQ ID NO: 5681 - protein, 9 aa, Artificial Sequence
  Synthetic
LQDYNYPWT

SEQ ID NO: 5682 - protein, 124 aa, Artificial Sequence
  Synthetic
QVQLQESGPGLVKPSGTLSLTCTVSGGSVSSGSYYWSWIRQPPGKGLEWIGYIDYSGSTNYNPSLKSRVTISVDTSKNQFSLNLSSVTAADTAVYYCARLGDYSGYGMYYFDYWSQGTLVSVSS

SEQ ID NO: 5683 - protein, 16 aa, Artificial Sequence
  Synthetic
ARLGDYSGYGMYYFDY

SEQ ID NO: 5684 - protein, 108 aa, Artificial Sequence
  Synthetic
DIQMTQSPSSLSASVGDRVTITCRAGQSISIYLNWYQQKPGKAPKLLIYAASSLQSGVPSRFSGSGSGTDFTLTISSLQPEDFATYYCQQSYSTHMYTFGQGTKLEIK

SEQ ID NO: 5685 - protein, 10 aa, Artificial Sequence
  Synthetic
QQSYSTHMYT

SEQ ID NO: 5686 - protein, 116 aa, Artificial Sequence
  Synthetic
QVQLQESGPGLVKPSGTLSLTCAVSGGSISSRNWWSWVRQPPGKGLEWIGEIYHSGSTSYNPSLKSRVTISVDKSKNQFSLYLNSVTAADTAVYYCARSSGLLDYWGQGTLVTVSS

SEQ ID NO: 5687 - protein, 9 aa, Artificial Sequence
  Synthetic
ARSSGLLDY

SEQ ID NO: 5688 - protein, 106 aa, Artificial Sequence
  Synthetic
DIQMTQSPSSLSASVGDRVTITCRASQGISNSLAWYQQKPGKAPKLLLYAASTLESGVPSRFSGSGSGTDYTLTISSLQPEDFATYYCQQYYSTRTFGQGTKVEIK

SEQ ID NO: 5689 - protein, 8 aa, Artificial Sequence
  Synthetic
QQYYSTRT

SEQ ID NO: 5690 - protein, 124 aa, Artificial Sequence
  Synthetic
EVQLVESGGGLVQPGGSLRLSCAASGFTFSSYDMHWVRQGTGKGLEWVSTVGTAGDTYYPDSVKGRFTVSRENAKNSLYLQMNSLRAGDTAVYYCARVTHIQQWLAHYWYFDLWGRGTLVTVSS

SEQ ID NO: 5691 - protein, 18 aa, Artificial Sequence
  Synthetic
ARVTHIQQWLAHYWYFDL

SEQ ID NO: 5692 - protein, 108 aa, Artificial Sequence
  Synthetic
DIQMTQSPSSLSASVGDRVTITCRASQTISRYLNWYQQKPGKAPKVLIYAASSLQSGVPSRFSGSGSGTLFTLIISSLQPEDFATYYCQQSYSSPPWTFGPGTIVDIK

SEQ ID NO: 5693 - protein, 10 aa, Artificial Sequence
  Synthetic
QQSYSSPPWT

SEQ ID NO: 5694 - protein, 116 aa, Artificial Sequence
  Synthetic
EVQLVESGGGLVQPGGSLRLSCAVSGFTVSSNYMTWVRQAPGKGLEWVSLIYSGGSTFYADSVKGRFTISRDNSKNTLYLQMSSLKVEDTAVYYCARGPYPAPPIWGQGTMVTVSS

SEQ ID NO: 5695 - protein, 10 aa, Artificial Sequence
  Synthetic
ARGPYPAPPI

SEQ ID NO: 5696 - protein, 107 aa, Artificial Sequence
  Synthetic
DIQMTQSPSSLSASVGDRVTITCQASQDISKYLNWYQQKPGRAPKVLIYDASNLETGVPSRFSGSGSGTVFTFTISSLQPEDIATYYCQQYDNLPVTFGPGTKVDIK

SEQ ID NO: 5697 - protein, 9 aa, Artificial Sequence
  Synthetic
QQYDNLPVT

SEQ ID NO: 5698 - protein, 117 aa, Artificial Sequence
  Synthetic
EVQLVESGGGLIQPGGSLRLSCAASGLTVSSNYMTWVRQAPGKGLEWVSLIYSGGSTFYADSVKGRFTISRDNSKNTLYLQMNSLRAEDTAIYYCARDLYYYGMDVWGQGTTVTVSS

SEQ ID NO: 5699 - protein, 11 aa, Artificial Sequence
  Synthetic
ARDLYYYGMDV

SEQ ID NO: 5700 - protein, 106 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISRLQPEDFATYYCQQINDYPFFGGGTKVEIK

SEQ ID NO: 5701 - protein, 8 aa, Artificial Sequence
  Synthetic
QQINDYPF

SEQ ID NO: 5702 - protein, 120 aa, Artificial Sequence
  Synthetic
QVQLQESGPGLVKPSQTLSLTCTVSGGSISSGGYYWSWIRQHPGKGLEWIGYIHYSGNSYYNPSLKSRVTISVDTSKNQFSLKVKSVTAADTAVYYCARDGDVAGNFDYWGQGTLVTVSS

SEQ ID NO: 5703 - protein, 12 aa, Artificial Sequence
  Synthetic
ARDGDVAGNFDY

SEQ ID NO: 5704 - protein, 108 aa, Artificial Sequence
  Synthetic
EIVLTQSPATLSLSPGERATLSCRASQSVSRYLAWYQQKPGQAPRLLIYDASNRATGVPARFSGSGSGTDFTLTIDSLEPEDFAVYYCQQRYNWPPYTFGQGTKLEIK

SEQ ID NO: 5705 - protein, 10 aa, Artificial Sequence
  Synthetic
QQRYNWPPYT

SEQ ID NO: 5706 - protein, 129 aa, Artificial Sequence
  Synthetic
QVQLVQSGAEVKKPGASVRVSCKASGYTFTNYYMHWVRQAPGQGLEWMGIINPSGGSTSYAPKFQGRFTMTRDTSASTVYMEVSSLRSEDTAVYYCARDVRDYDFWSGYSSPYYGMDVWGQGTTITVSS

SEQ ID NO: 5707 - protein, 22 aa, Artificial Sequence
  Synthetic
ARDVRDYDFWSGYSSPYYGMDV

SEQ ID NO: 5708 - protein, 112 aa, Artificial Sequence
  Synthetic
DIVMTQSPLSLPVTPGEPASISCRSSQSLLHSNGYNYLDWYLQKPGQSPQLLIYLGSNRASGVPDRFSGSGSGTDFTLKISRVEAADVGVYYCMQALQTPFTFGPGTNVDIK

SEQ ID NO: 5709 - protein, 9 aa, Artificial Sequence
  Synthetic
MQALQTPFT

SEQ ID NO: 5710 - protein, 122 aa, Artificial Sequence
  Synthetic
QVQLVQSGAEVKKPGASVKVSCKTSGYTFTNYYMHWVRQAPGQGLEWMGIINPSAGSITYAQKFQGRVTMTRDTSTSTVYMELSSLRSEDTAVYYCARDIVVVPATDAFEIWGQGTMVTVSS

SEQ ID NO: 5711 - protein, 15 aa, Artificial Sequence
  Synthetic
ARDIVVVPATDAFEI

SEQ ID NO: 5712 - protein, 109 aa, Artificial Sequence
  Synthetic
EIVLTQSPATLSLSPGERATLSCRASQSVSSYLAWYQQKPGQAPRLLIYDASNRATGISARFSGSGSGTDFTLTISSLEPEDFAVYYCQQRSNWPPRFTFGPGTKVDIK

SEQ ID NO: 5713 - protein, 11 aa, Artificial Sequence
  Synthetic
QQRSNWPPRFT

SEQ ID NO: 5714 - protein, 125 aa, Artificial Sequence
  Synthetic
QVQLVQSGGEVKKPGASVKVSCRASGYTFTSYSISWVRQAPGQGLEWMGWIYTYNGDTNYAQKLQGRVTMTTDTSTSTVYMELRSLRSDDTAVYYCARVETYYCSGGSCYFYDYWGQGTLVTVSS

SEQ ID NO: 5715 - protein, 18 aa, Artificial Sequence
  Synthetic
ARVETYYCSGGSCYFYDY

SEQ ID NO: 5716 - protein, 109 aa, Artificial Sequence
  Synthetic
EIVMTQSPATLSVSPGERATLSCRASQSVSSNLGWYQQKPGQAPRLLIYGASTRATGIPARFSGSGSGTEFTLTISSLQSEDFAVYYCQQYDNWPPTWTFGQGTKVEIK

SEQ ID NO: 5717 - protein, 11 aa, Artificial Sequence
  Synthetic
QQYDNWPPTWT

SEQ ID NO: 5718 - protein, 123 aa, Artificial Sequence
  Synthetic
QMQLVQSGPEVKKPGTSVKVSCKASAFTFTSSAVQWVRQARGQRLEWIGWIVVGSGNTDSAQKFQDRVTLSRDTSTSTAYMELSSLRSEDTAVYYCAAPYCSGGTCYDGFNIWGQGTMVTVSS

SEQ ID NO: 5719 - protein, 16 aa, Artificial Sequence
  Synthetic
AAPYCSGGTCYDGFNI

SEQ ID NO: 5720 - protein, 108 aa, Artificial Sequence
  Synthetic
EIVLTQSPGTLSLSPGERATLSCRASQSVRSSYLAWYQQKPGQAPRLLIYGASSRATGIPDRVSGSGSGTDFTLTISRLEPEDFAVYYCQQYDRSPWTFGQGTKVEIK

SEQ ID NO: 5721 - protein, 9 aa, Artificial Sequence
  Synthetic
QQYDRSPWT

SEQ ID NO: 5722 - protein, 120 aa, Artificial Sequence
  Synthetic
QVQLQESGPGLVKPSETLSLTCTVSGGSISSYYWSWIRQPPGKGLEWIGYIHHSESPNYTPSLKSRVSISVDSSKNRFSLRLSSVTAADTAVYYCARDYGNWNYGGFDHWGLGTLVTVSS

SEQ ID NO: 5723 - protein, 14 aa, Artificial Sequence
  Synthetic
ARDYGNWNYGGFDH

SEQ ID NO: 5724 - protein, 107 aa, Artificial Sequence
  Synthetic
DIQMTQSPSSLSASVGDRVTITCRASQTISTYLNWYQQKPGKAPKLLIYAESSLQSGVPSRFSGSGSGTDFTLTINSLHPEDFATYYCQQSYSTPYTFGQGTKLEIK

SEQ ID NO: 5725 - protein, 9 aa, Artificial Sequence
  Synthetic
QQSYSTPYT

SEQ ID NO: 5726 - protein, 127 aa, Artificial Sequence
  Synthetic
QVQLVESGGGVVQPGRSLRLSCVASGFTFSRYAMHWARQAPGKGLEWVAVISFDGSNRYYADSVKGRFTISRDNSKNTLYLQMNSLRAEDTAVYYCAKQGGEYCSGYNCYSGYFDYWGQGTLVTVSS

SEQ ID NO: 5727 - protein, 20 aa, Artificial Sequence
  Synthetic
AKQGGEYCSGYNCYSGYFDY

SEQ ID NO: 5728 - protein, 106 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYENLPLFGGGTKVEIK

SEQ ID NO: 5729 - protein, 8 aa, Artificial Sequence
  Synthetic
QQYENLPL

SEQ ID NO: 5730 - protein, 127 aa, Artificial Sequence
  Synthetic
QVQLVQSGAEVKKPGSSVKVSCKASGGTFSSYTISWVRQAPGQGLEWMGRIIPTLGIASYAQKFQGRVTITADKSTTTAYMALSSLRSEDTAVYYCARDRWLADVVVPAAIYPLGYWGQGTLVTVSS

SEQ ID NO: 5731 - protein, 20 aa, Artificial Sequence
  Synthetic
ARDRWLADVVVPAAIYPLGY

SEQ ID NO: 5732 - protein, 107 aa, Artificial Sequence
  Synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSSPGTFGQGTKLEIK

SEQ ID NO: 5733 - protein, 9 aa, Artificial Sequence
  Synthetic
QQYNSSPGT

SEQ ID NO: 5734 - protein, 128 aa, Artificial Sequence
  Synthetic
EVQLLESGGGLVQPGGSLRLSCAASGFTFSSYAMSWVRQAPGKGLEWVSGISASDGSTYYADSVKGRFTVSRDNSKNTLYLLMNSLRAEDTAVYYCAKRGGYCTSTICYTRYYYMDVWGKGTTVTVSS

SEQ ID NO: 5735 - protein, 21 aa, Artificial Sequence
  Synthetic
AKRGGYCTSTICYTRYYYMDV

SEQ ID NO: 5736 - protein, 107 aa, Artificial Sequence
  Synthetic
DIQMTQSPSSVSASVGDRVTITCRASQDISSWLAWYQQKPGKAPKLLIYAASSLQSGVPSRFSGSGSGTDFTLTISSLQPEDFATYYCQQANSFPLTFGGGTKVEIK

SEQ ID NO: 5737 - protein, 9 aa, Artificial Sequence
  Synthetic
QQANSFPLT

SEQ ID NO: 5738 - protein, 122 aa, Artificial Sequence
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRDEDTAVYYCAREEGYGDWYYGMDVWGQGTTVTVSS

SEQ ID NO: 5739 - protein, 15 aa, Artificial Sequence
  Synthetic
AREEGYGDWYYGMDV

SEQ ID NO: 5740 - protein, 107 aa, Artificial Sequence
  Synthetic
DIQMTQSPSSLSASVGDRVTITCRASQSISSYLNWYQQKPGKAPKLLIYEASSLQSGVPSRFSGSGSGTDFTLTISSLQPEDFATYYCQQSYSTLRTFGQGTKVEIK

SEQ ID NO: 5741 - protein, 9 aa, Artificial Sequence
  Synthetic
QQSYSTLRT

SEQ ID NO: 5742 - protein, 122 aa, Artificial Sequence
  Synthetic
QVQLVESGGGLVKPGGSLRLSCVASGFTFSDYFMSWIRQAPGKGLEWVSYVSSSGSSRYYADSVEGRFTISRDNAKNSLYLQMNSLRAEDTAVYYCARDRRGWYQLDAFDIWGQGTMVTVSS

SEQ ID NO: 5743 - protein, 15 aa, Artificial Sequence
  Synthetic
ARDRRGWYQLDAFDI

SEQ ID NO: 5744 - protein, 112 aa, Artificial Sequence
  Synthetic
DVVMTQSPLSLPVTLGQPASISCRSSQSLVYSDGNTYLNWFQQRPGQSPRRLIYRVSNRDSGVPDRFSGSGSGTDFTLKISRVEAEDVGVYYCMQGTHWPPTFGQGTRLEIK

SEQ ID NO: 5745 - protein, 9 aa, Artificial Sequence
  Synthetic
MQGTHWPPT

SEQ ID NO: 5746 - protein, 121 aa, Artificial Sequence
  Synthetic
QVQLVQSGAEVKKPGSSVKVSCKASGGTFSSNAISWVRQAPGQGLEWMGGVTPIFGTTDYAQKFQGRVTISADESTSTAYMELSSLRSEDTAVYYCAMDHVVAPLYGMDVWGQGTTVTVSS

SEQ ID NO: 5747 - protein, 14 aa, Artificial Sequence
  Synthetic
AMDHVVAPLYGMDV

SEQ ID NO: 5748 - protein, 106 aa, Artificial Sequence
  Synthetic
DIQMTQSPSSLSASVGDRVTITCRASQSIRTYLNWYQQKPGKAPKLLIYAASTLQSGVPSTFSGSGSGTDFTLTISSLHPEDFATYYCQQSYSTPRTFGQGTKVEI

SEQ ID NO: 5749 - protein, 9 aa, Artificial Sequence
  Synthetic
QQSYSTPRT

SEQ ID NO: 5750 - protein, 124 aa, Artificial Sequence
  Synthetic
EVQLVESGGGLVQPGGSLRLSCAASGFTLSSDDMHWVRQATGKGLEWVSAIGTAGDTYYQASVKGRFTISRENAKNSLYLQMNSLRAGDTAVYYCARGRQQLLNYYYYYYMDVWGKGTTVTVSS

SEQ ID NO: 5751 - protein, 18 aa, Artificial Sequence
  Synthetic
ARGRQQLLNYYYYYYMDV

SEQ ID NO: 5752 - protein, 108 aa, Artificial Sequence
  Synthetic
DIQMTQSPSSLSASVGDRVSITCRASQSIRSYLNWYQQRPGKAPKLLIYGASSLQSGVPSRFSGSGSGTDFTLTISSLQPEDFATYYCQQSYSSPPWTFGPGTKVEIK

SEQ ID NO: 5753 - protein, 10 aa, Artificial Sequence
  Synthetic
QQSYSSPPWT

SEQ ID NO: 5754 - protein, 124 aa, Artificial Sequence
  Synthetic
QVQLVESGGGVVQPGRSLRLSCAASGFTFRSYGMHWVRQAPGKGLEWVAVISYDGSNKYYADSVKGRITISRDNSKNTLYLQMNSLRAEDTAVYYCAKLNYDNGGYDFTDFDYWGQGTLVTVSS

SEQ ID NO: 5755 - protein, 17 aa, Artificial Sequence
  Synthetic
AKLNYDNGGYDFTDFDY

SEQ ID NO: 5756 - protein, 107 aa, Artificial Sequence
  Synthetic
DIQMTQSPSSLSASVGDRVTITCRASQGIRHFLAWYQQKPGKVPKLLIYAASTLQSGVPSRFSGSGSGTDFTLTISSLQPEDVATYYCQKYNSAPFTFGPGTKVDLK

SEQ ID NO: 5757 - protein, 9 aa, Artificial Sequence
  Synthetic
QKYNSAPFT

SEQ ID NO: 5758 - protein, 122 aa, Artificial Sequence
  Synthetic
QVQLVESGGGVVQPGRSLRLSCAASGFTLSNYAMHWVRQAPGKGLEWVAIISDDGTIKYYGDSVKGRFTISRDNPKNTLYLQMNSLRAEDTAVYYCARDQRTYYGFNYFDYWGQGTLVTVSS

SEQ ID NO: 5759 - protein, 15 aa, Artificial Sequence
  Synthetic
ARDQRTYYGFNYFDY

SEQ ID NO: 5760 - protein, 108 aa, Artificial Sequence
  Synthetic
DIQMTQSPSSLSASVGDRVTITCRASQSISSYLNWYQQKPGKAPKVLIYAASTLQSGVPSRFSGSGSGTDFTLTISSLQPEDFATYYCQQSYSTHSFTFGPGTKVDIK

SEQ ID NO: 5761 - protein, 10 aa, Artificial Sequence
  Synthetic
QQSYSTHSFT

SEQ ID NO: 5762 - protein, 128 aa, Artificial Sequence
  Synthetic
EVQLVESGGGLVKPGGSLRLSCAASGFTFSYAWMSWVRQAPGKGLEWVGRIKSKTDGGTTDYAAPVKGRFTISRDDSKNTLFLQMKSLKTEDTAVYYCTSDKYDFLTGFIERDAFDIWGQGTKVTVSS

SEQ ID NO: 5763 - protein, 19 aa, Artificial Sequence
  Synthetic
TSDKYDFLTGFIERDAFDI

SEQ ID NO: 5764 - protein, 106 aa, Artificial Sequence
  Synthetic
DIQMTQSPSSLSASVGDRVTITCRASQSISSFLNWYQQKPGKAPKLLIYAASSLQSGVPSRFSGSGSGTDFTLTISSLQPEDFATYYCQQSYSTLSFGQGTKLEIK

SEQ ID NO: 5765 - protein, 8 aa, Artificial Sequence
  Synthetic
QQSYSTLS

SEQ ID NO: 5766 - protein, 131 aa, Artificial Sequence
  Synthetic
EVQLVESGGGLVQPGGSLRLLCAASGFTFSSDDMHWVRQATGKGLEWVSAIGTAGDTYYPDSVKGRFTISRENAKNSLYLQMNSLRAGDTAVYYCARGRHIPDNSSGWYRSVHYYYYMDVWGKGTTVTVSS

SEQ ID NO: 5767 - protein, 25 aa, Artificial Sequence
  Synthetic
ARGRHIPDNSSGWYRSVHYYYYMDV

SEQ ID NO: 5768 - protein, 108 aa, Artificial Sequence
  Synthetic
DIQMTQSPSSLSASVGDRVSITCRASQSISSYLNWYQLKPGKAPKLLIYAASSLQSGVPSRFSGSGSGTDFTLTINSLQPEDFATYYCQQSYSTPPWTFGQGTKVEIK

SEQ ID NO: 5769 - protein, 10 aa, Artificial Sequence
  Synthetic
QQSYSTPPWT

SEQ ID NO: 5770 - protein, 123 aa, Artificial Sequence
  Synthetic
QMQLVQSGPEMKKPGTSVKVSCKASGFTFASSAVQWVRQARAQGLEWIGWIVVGSGNTNYAQKFQERVTISRDMSTNTAYMELSSLGSEDTAVYYCAAPHCNRTSCFDGFDIWGQGTMVTVSS

SEQ ID NO: 5771 - protein, 16 aa, Artificial Sequence
  Synthetic
AAPHCNRTSCFDGFDI

SEQ ID NO: 5772 - protein, 108 aa, Artificial Sequence
  Synthetic
EIVLTQSPGTLSLSPGEGATLSCRASQTVRSSYLGWYQQKPGQAPRLLIYGASSRATGIPDRFSGSGSGTDFTLTISRLEPEDFAVYYCQQYGSSPWTFGQGTKVEIK

SEQ ID NO: 5773 - protein, 9 aa, Artificial Sequence
  Synthetic
QQYGSSPWT

SEQ ID NO: 5774 - protein, 124 aa, Artificial Sequence
  Synthetic
EVQLVESGGGLVQPGRSLRLSCAASGFTFDDYAMHWVRQAPGKGLEWVSGISWNSGSIGYADSVRGRFTISRDNAKNSLYLQMNSLRAEDTAFYYCAKDIAPGIVGPIDYFNYWGQGTLVTVSS

SEQ ID NO: 5775 - protein, 17 aa, Artificial Sequence
  Synthetic
AKDIAPGIVGPIDYFNY

SEQ ID NO: 5776 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYENLPLTFGGGTKVEIK

SEQ ID NO: 5777 - protein, 9 aa, Artificial Sequence
  Synthetic
QQYENLPLT

SEQ ID NO: 5778 - protein, 124 aa, Artificial Sequence
  Synthetic
EVQLLESGGGLVQPGGSLRLSCAASGFTFRNYAMSWVRQAPGKGLEWVSAISGSGGSTYYADSVKGRFTISRDNSKNTLYLQMNSLRAEDTAVYYCAKDRILSGMTTVTIFDYWGQGTLVTVSS

SEQ ID NO: 5779 - protein, 17 aa, Artificial Sequence
  Synthetic
AKDRILSGMTTVTIFDY

SEQ ID NO: 5780 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDIFLGTFGPGTKVDIK

SEQ ID NO: 5781 - protein, 9 aa, Artificial Sequence
  Synthetic
QQYDIFLGT

SEQ ID NO: 5782 - protein, 128 aa, Artificial Sequence
  Synthetic
QVQLVQSGAEVKKPGSSVKVSCKTSGGTFSSDTISWVRQAPGQGPEWMGRIIPILGITNYAQKFQGRVTITADKSTSTAYMELSSLRSEDTAVYYCARAHCSSTSCYIGGSSDYFDSWGQGTLVTVSS

SEQ ID NO: 5783 - protein, 21 aa, Artificial Sequence
  Synthetic
ARAHCSSTSCYIGGSSDYFDS

SEQ ID NO: 5784 - protein, 108 aa, Artificial Sequence
  Synthetic
EIVLTQSPGTLSLSPGERATLSCRASQTVTSSYLAWYQQKPGQAPRLLIYGASSRATGIPDRFSGSGSGTDFTLTISRLEPEDFAVYYCQQYGSSPYTFGQGTKLEIK

SEQ ID NO: 5785 - protein, 9 aa, Artificial Sequence
  Synthetic
QQYGSSPYT

SEQ ID NO: 5786 - protein, 121 aa, Artificial Sequence
  Synthetic
EVQLLESGGGLVQPGGSLRLSCAASAFTFRNYAMNWVRQAPGKGLEWVSAISGSGGSTYYADSVKGRFTISRDNSKNTLYLQMNSLRAEDTAVYYCAKAIAAAGYSVLDYWGQGTLVTVSS

SEQ ID NO: 5787 - protein, 14 aa, Artificial Sequence
  Synthetic
AKAIAAAGYSVLDY

SEQ ID NO: 5788 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLRLTFGGGTKVEIK

SEQ ID NO: 5789 - protein, 9 aa, Artificial Sequence
  Synthetic
QQYDNLRLT

SEQ ID NO: 5790 - protein, 125 aa, Artificial Sequence
  Synthetic
QVQLVQSGAEVKKPGSSVKVSCKASGGTFSRHTFSWVRQAPGQGLEWMGRVIPMVGVVDYAQRFQGRVTITADKSTTTAYMELSSLRSEDTAVYYCATHIVLVEFGGGDDAFDIWGQGTMVTVSS

SEQ ID NO: 5791 - protein, 18 aa, Artificial Sequence
  Synthetic
ATHIVLVEFGGGDDAFDI

SEQ ID NO: 5792 - protein, 107 aa, Artificial Sequence
  Synthetic
DIQMTQSPSSLSASVGDRVTITCRASQSITRYLNWYQQKPGKAPKLLIYAASSLQSGVPSRFSGSGSGTDFTLTISSLQPEDFATYYCQQSYSTPWTFGQGTKVEIK

SEQ ID NO: 5793 - protein, 9 aa, Artificial Sequence
  Synthetic
QQSYSTPWT

SEQ ID NO: 5794 - protein, 123 aa, Artificial Sequence
  Synthetic
QVQLVQSGAEVKKPGSSVKVSCKASGGTFSSDAISWVRQAPGQGFEWMGRVIPVLGIATYAQRFQGRVTITADKSTSTAYMELSSLRSEDTAVYYCARWSPAAHGTGYYFDYWGQGTLVTVSS

SEQ ID NO: 5795 - protein, 16 aa, Artificial Sequence
  Synthetic
ARWSPAAHGTGYYFDY

SEQ ID NO: 5796 - protein, 107 aa, Artificial Sequence
  Synthetic
EIVMTQSPATLSVSPGERATLSCRASQSVSSNLAWYQQIPGQAPRLLIYGASTRATGIPARFSGSGSGTEFTLTISSLQSEDFAVYYCQQYHNWGGTFGQGTKVEIK

SEQ ID NO: 5797 - protein, 9 aa, Artificial Sequence
  Synthetic
QQYHNWGGT

SEQ ID NO: 5798 - protein, 125 aa, Artificial Sequence
  Synthetic
EVQLVESGGGLVQPGGSLRLSCAASGFMFSSYWMSWVRQAPGKGLEWVANIKQDGSETYYVDSVKGRFTISRDNAKHSLYLQMNSVGVEDTAVYYCARDLGLLWFGEDPRARDVWDRGTTVTVSS

SEQ ID NO: 5799 - protein, 18 aa, Artificial Sequence
  Synthetic
ARDLGLLWFGEDPRARDV

SEQ ID NO: 5800 - protein, 107 aa, Artificial Sequence
  Synthetic
DIQMTQSPSSLSASVGDRVTITCRASQDISNSLAWYQQTPGKAPKLLLYTASTLESGVPSRFSGSGSGTDFTLTISSLQPQDFATYYCQHYYSAPRTFGQGTKLEIK

SEQ ID NO: 5801 - protein, 9 aa, Artificial Sequence
  Synthetic
QHYYSAPRT

SEQ ID NO: 5802 - protein, 125 aa, Artificial Sequence
  Synthetic
EVQLVESGGGLVQPGGSLRLSCAASGFTFSTYWMSWVRQAPGKGLEWVANIKQDGSEKYYVDSVKGRFTISRDNAKNSMYLQMNSLRAEDTAVYFCARDLGLLWFGEDPLARDVWGEGTTVTVSS

SEQ ID NO: 5803 - protein, 18 aa, Artificial Sequence
  Synthetic
ARDLGLLWFGEDPLARDV

SEQ ID NO: 5804 - protein, 107 aa, Artificial Sequence
  Synthetic
DIQMTQSPSSLSASVGDRVTITCRASQGISNSLAWYQQTPGKAPKLLLYAASTLESGVPSRFSGSGSGTDYTLTISSLQPQDFATYYCLQYYSMPRTFGQGTKLEIK

SEQ ID NO: 5805 - protein, 9 aa, Artificial Sequence
  Synthetic
LQYYSMPRT

SEQ ID NO: 5806 - protein, 116 aa, Artificial Sequence
  Synthetic
QVQLQESGPGLVKPSGTLSLTCAVSGASISSRNWWSWVRQPPGKGLEWIGEIFHSGSTNYNPSLKSRVTISVDKSKNHFSLKLSSVTAADTAVYYCARSSGLLDYWGQGTLVTVSS

SEQ ID NO: 5807 - protein, 9 aa, Artificial Sequence
  Synthetic
ARSSGLLDY

SEQ ID NO: 5808 - protein, 107 aa, Artificial Sequence
  Synthetic
DIQMTQSPSTLSASVGDRVTITCRASQSISSWLAWDQRKPGKAPNLLIYKASSLESGVPSRFSGSGSGTECSLTISSLQPDDFATYCCQQYNSYLYSFGQGTKLEIK

SEQ ID NO: 5809 - protein, 9 aa, Artificial Sequence
  Synthetic
QQYNSYLYS

SEQ ID NO: 5810 - protein, 116 aa, Artificial Sequence
  Synthetic
EVQLVESGGGLVQPGGSLRLSCAASGVTVSSNYMSWVRQAPGKGLEWVSVIYSGGSTFYADSVKGRFTISRHNSKNTLFLQMNSLRAEDTAVYYCARGIYDTFDIWGQGTMVTVSS

SEQ ID NO: 5811 - protein, 10 aa, Artificial Sequence
  Synthetic
ARGIYDTFDI

SEQ ID NO: 5812 - protein, 108 aa, Artificial Sequence; identical to SEQ ID NO: 1044
  Synthetic

SEQ ID NO: 5813 - protein, 10 aa, Artificial Sequence
  Synthetic
QQLNSYPGFT

SEQ ID NO: 5814 - protein, 126 aa, Artificial Sequence
  Synthetic
QVQLVESGGGVVQPGRSLRLSCAASGFTFRNYGMHWVRQAPGKGLEWVAVIWYDGGNKNYADSVKGRFTISRDNSKNTLYLQMNSLRPEDTAVYYCARALMLGPMVDLDNDAFDIWGQGTMVTVSS

SEQ ID NO: 5815 - protein, 19 aa, Artificial Sequence
  Synthetic
ARALMLGPMVDLDNDAFDI

SEQ ID NO: 5816 - protein, 107 aa, Artificial Sequence
  Synthetic
DIQMTQSPSSLSASVGDRVTITCRASQSISRYLNWYQQKPGKAPKLLIYAASSSQSGVPSRFSGSGSGTDFTLTISSLQPEDFATYYCQQSYSSPLTFGGGTKVEIK

SEQ ID NO: 5817 - protein, 9 aa, Artificial Sequence
  Synthetic
QQSYSSPLT

SEQ ID NO: 5818 - protein, 117 aa, Artificial Sequence
  Synthetic
QLQLQESGPGLVKPSETLSLTCSVSGGSISSSSYYWGWIRQPPGTGLEWIGSISYSGSTYYNPSLKSRVTISVDTSKNQFSLKLSSVTAADTAVYYCARLLGAVFGWGQGTLVTVSS

SEQ ID NO: 5819 - protein, 9 aa, Artificial Sequence
  Synthetic
ARLLGAVFG

SEQ ID NO: 5820 - protein, 108 aa, Artificial Sequence
  Synthetic
DIQMTQSPSSLSASVGDRVTITCRASQGISNSLAWYQQKPGKAPKLLLYATSTLESGVPSRFSGSGSGTDYTLTISSLQPEDFATYYCQQYYSTPPLTFGGGTKVEIK

SEQ ID NO: 5821 - protein, 10 aa, Artificial Sequence
  Synthetic
QQYYSTPPLT

SEQ ID NO: 5822 - protein, 121 aa, Artificial Sequence
  Synthetic
QVQLVQSGAEVKKPGSSVKVSCKASGGTFSSDAINWVRQAPGQGLEWMGGIIPIFGTINYAQKFQGRVTITADESTSTAYMELSSLRSEDTAVYYCAKDVTTSPLYGMDVWGQGTMVTVSS

SEQ ID NO: 5823 - protein, 14 aa, Artificial Sequence
  Synthetic
AKDVTTSPLYGMDV

SEQ ID NO: 5824 - protein, 108 aa, Artificial Sequence
  Synthetic
DIQMTQSPSSLSASVGDRVTITCRASQSISSYLNWYQQKPGKAPKLLIYGASSLQSGVPSRFSGSGSGTDFTLTISSLQPEDFATYYCQQSYRTPLVTFGGGTKVEIK

SEQ ID NO: 5825 - protein, 10 aa, Artificial Sequence
  Synthetic
QQSYRTPLVT

SEQ ID NO: 5826 - protein, 121 aa, Artificial Sequence
  Synthetic
QVQLVQSGAEVKKPGSSVKVSCKASGGTFSSHAINWVRQAPGQGLEWMGRIIPIFGTANYAQKFQGRVTITADESTSTAYMELSSLRSEDTAVYYCARDLPTAPLYGMDIWGQGTTVTVSS

SEQ ID NO: 5827 - protein, 14 aa, Artificial Sequence
  Synthetic
ARDLPTAPLYGMDI

SEQ ID NO: 5828 - protein, 106 aa, Artificial Sequence
  Synthetic
DIQMTQSPSSLSASVGDRVTITCRASQSISRYLNWYQQKPGKAPKLLIYAASSLQSGVPSRFSGSGSGTDFTLTISSLQPEDFATYYCQQSVSTHTFGQGTKLEIK

SEQ ID NO: 5829 - protein, 8 aa, Artificial Sequence
  Synthetic
QQSVSTHT

SEQ ID NO: 5830 - protein, 121 aa, Artificial Sequence
  Synthetic
QVQLVQSGAEVKKPGSSLKVSCKASGGTFSSNAINWVRQAPGQGLEWMGRIIPIFGTTHHAQKFQGRVTITADESTSTAYMELSSLRSEDTAVYYCATDVTTSPLYGMDVWGQGTTVTVSS

SEQ ID NO: 5831 - protein, 14 aa, Artificial Sequence
  Synthetic
ATDVTTSPLYGMDV

SEQ ID NO: 5832 - protein, 108 aa, Artificial Sequence
  Synthetic
DIQMTQSPSSLSASVGDRVTITCRASQTISRYLNWYQQKPGTAPKLLIYAASSLQSGVPSRFSGSGSGTDFTLTISSLQPEDFATYYCQQSYSTPLLTFGGGTKVEIK

SEQ ID NO: 5833 - protein, 10 aa, Artificial Sequence
  Synthetic
QQSYSTPLLT

SEQ ID NO: 5834 - protein, 122 aa, Artificial Sequence
  Synthetic
QVQLVQSGAEVKKPGASVKVSCKASGYTFTSYYMHWVRQAPGQGLEWMGIINPSGGTTNYAQNFQGRLSMTRDTSTSTVYMELTSLRSEDTAVYYCAREQGSGYSSFPFDIWGQGTMVTMSS

SEQ ID NO: 5835 - protein, 15 aa, Artificial Sequence
  Synthetic
AREQGSGYSSFPFDI

SEQ ID NO: 5836 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTDFTLTISSLQPEDFATYYCQQLISYPYTFGQGTKLEIK

SEQ ID NO: 5837 - protein, 9 aa, Artificial Sequence
  Synthetic
QQLISYPYT

SEQ ID NO: 5838 - protein, 116 aa, Artificial Sequence
  Synthetic
QVQLVQSGAEVKKPGASVKVSCKASGFTLTSYGISWVRQAPGQGLEWMGWISGDSGKKNYAQQLQGRVTLTTETSMSTAYLELRSLRSDDTAVYYCARSTGILDCWGQGTLVTVSS

SEQ ID NO: 5839 - protein, 9 aa, Artificial Sequence
  Synthetic
ARSTGILDC

SEQ ID NO: 5840 - protein, 108 aa, Artificial Sequence
  Synthetic
DIQMTQSPSSLSASVGDRVTITCRASQGISNSLAWYQQKPGKAPKLLLYGASTLESGVPSRFSGSGSGTDYTLTISSLQPEDFATYYCQQYYSSRGFTFGPGTKVDIK

SEQ ID NO: 5841 - protein, 10 aa, Artificial Sequence
  Synthetic
QQYYSSRGFT

SEQ ID NO: 5842 - protein, 116 aa, Artificial Sequence
  Synthetic
QVQLQESGPGLVKPSGTLSLTCAVSGGSISSTNWWSWVRQPPGKGLEWIGEIFHSGSTKYNPSLKSRVTISVDKSKKQFSLKLSSVTAADTAVYYCARVSGLFDYWGQGTLVTVSS

SEQ ID NO: 5843 - protein, 9 aa, Artificial Sequence
  Synthetic
ARVSGLFDY

SEQ ID NO: 5844 - protein, 107 aa, Artificial Sequence
  Synthetic
DIQMTQSPSSLSASVGDRVTITCRASQGISNSLAWYQQKPGKAPKLLLYAASTLESGVPSRFGGRGSGTDYTLTISSLQPEDFATYYCQQYYGTVRTFGHGTKVDIK

SEQ ID NO: 5845 - protein, 9 aa, Artificial Sequence
  Synthetic
QQYYGTVRT

SEQ ID NO: 5846 - protein, 126 aa, Artificial Sequence
  Synthetic
QVQLVQSGAEVKKPGSSVKVSCKASGGTFSSYAISWVRQAPGQGLEWMGGIIPIFGTANYAQKFQGRITITADESTSTAYMELSSLRSEDTAVYYCARDTSAYGSGSHYNSGWNYWGQGTLVTVSS

SEQ ID NO: 5847 - protein, 19 aa, Artificial Sequence
  Synthetic
ARDTSAYGSGSHYNSGWNY

SEQ ID NO: 5848 - protein, 106 aa, Artificial Sequence
  Synthetic
DIQMTQSPTLSASVGDRVTITCQASQDISNYLNWYQQKPGKAPKLLIYDASNLETGVPSRFSGSGSGTDFTFTISSLQPEDIATYYCQQYHNLPLTFGGGTKVEIK

SEQ ID NO: 5849 - protein, 9 aa, Artificial Sequence
  Synthetic
QQYHNLPLT

SEQ ID NO: 5850 - protein, 118 aa, Artificial Sequence
  Synthetic
EVQLVQSGAEVKKPGESLKISCKGSGYIFTTFWIGWVRQMPGKGLEWMGIIYPGDSDTRYSPSFQGQVTISADKSISTAYLQWSSLKASDTAMYYCATLALDTAVDFWGPGTLVTVSS

SEQ ID NO: 5851 - protein, 11 aa, Artificial Sequence
  Synthetic
ATLALDTAVDF

SEQ ID NO: 5852 - protein, 114 aa, Artificial Sequence
  Synthetic
DIVMTQSPDSLAVSLGERATINCKSSQSVLHSSNNKNYLAWYQQKPGQSPKLLIYWASTRDSGVPDRFSGSGSGTDFTLTISSLQAEDVAVYYCQQYYSSPMYTFGQGTKLEIK

SEQ ID NO: 5853 - protein, 10 aa, Artificial Sequence
  Synthetic
QQYYSSPMYT

SEQ ID NO: 5854 - protein, 124 aa, Artificial Sequence
  Synthetic
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRGNTVARYYYYYYYMDVWGKGTTVTVSS

SEQ ID NO: 5855 - protein, 18 aa, Artificial Sequence
  Synthetic
VRGNTVARYYYYYYYMDV

SEQ ID NO: 5856 - protein, 108 aa, Artificial Sequence
  Synthetic
DIQMTQSPSSLSASVGDRVTITCRASQSINTYLNWYQQRPGKAPRLLIYAASSLQSGVPSRFSGSGSGTDFTLTISSLQPEDFATYFCQQSYSSPPWTFGLGTKVEIK

SEQ ID NO: 5857 - protein, 10 aa, Artificial Sequence
  Synthetic
QQSYSSPPWT

SEQ ID NO: 5858 - protein, 115 aa, Artificial Sequence
  Synthetic
QVQLQESGPGLVKPSETLSLTCTVSGGSIRSYYWSWIRQPPGKGLEWVGSIYYSGSTNYNPSLKSRVSVSVDTSKNQFSLKLTSVTAADTAVYYCARGPPGFDSWGQGTLVTVSS

SEQ ID NO: 5859 - protein, 9 aa, Artificial Sequence
  Synthetic
ARGPPGFDS

SEQ ID NO: 5860 - protein, 107 aa, Artificial Sequence
  Synthetic
DIQMTQSPSSLSASVGDRVTITCRASQGISNSLAWYQQKPGKAPKLLLYAASTLESGVPSRFSGSGSGTDFTLTISSLQPEDFATYYCQQYYSTTWTFGQGTKVEIK

SEQ ID NO: 5861 - protein, 9 aa, Artificial Sequence
  Synthetic
QQYYSTTWT

SEQ ID NO: 5862 - protein, 123 aa, Artificial Sequence
  Synthetic
QVQLVESGGGVVQPGRSLRLSCAGSGFIFSDYALHWVRQAPGKGLEWVALISYDGGNKYYADSVKGRFTISRDNSKNTLYLQMNSLRAEDTAMYYCAREWVPMVTARTPFDYWGQGTLVTVSS

SEQ ID NO: 5863 - protein, 16 aa, Artificial Sequence
  Synthetic
AREWVPMVTARTPFDY

SEQ ID NO: 5864 - protein, 107 aa, Artificial Sequence
  Synthetic
DIQMTQSPSTLSASVGDRVTITCRASQSIRSWLAWYQQKPGKAPKLLIYKASSLESGVPSRFSGSGSGTEFTLTISSLQPDDFATYYCQQYNSYPLTFGGGTKVEIK

SEQ ID NO: 5865 - protein, 9 aa, Artificial Sequence
  Synthetic
QQYNSYPLT

SEQ ID NO: 5866 - protein, 122 aa, Artificial Sequence
  Synthetic
QVQLVQSGAEVKKPGASVKVSCKASGNTFTHYYMHWVRQAPGQGLEWMGIINPSGGSTSYAQKFQGRVTMTSDTSTSTVYMELSSLRFEDTAVYYCARGGIVPSASDAFDIWGQGTMVSVSS

SEQ ID NO: 5867 - protein, 15 aa, Artificial Sequence
  Synthetic
ARGGIVPSASDAFDI

SEQ ID NO: 5868 - protein, 108 aa, Artificial Sequence
  Synthetic
DIQMTQSPSTLSASVGDRVTITCRASQSISNWLAWYQQKPGKAPKLLIYKASSLESGVPSRFSGSGSGTEFTLTISSLQPDDFGTFYCQQCNSFAGYTFGQGTKLEIK

SEQ ID NO: 5869 - protein, 10 aa, Artificial Sequence
  Synthetic
QQCNSFAGYT

SEQ ID NO: 5870 - protein, 121 aa, Artificial Sequence
  Synthetic
QVQLVQSGAEVKKPGSSVKVSCKASRDTFSSYAISWVRQAPGQGLEWMGGIIPIFGTANYAQKFQGRVTIIADESTSTAYMELRSLRSDDTAVYYCARGGGSYGYNWFDPWGQGTLVTVSS

SEQ ID NO: 5871 - protein, 14 aa, Artificial Sequence
  Synthetic
ARGGGSYGYNWFDP

SEQ ID NO: 5872 - protein, 107 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYHCQQSNSVPDTFGQGTKLEIK

SEQ ID NO: 5873 - protein, 9 aa, Artificial Sequence
  Synthetic
QQSNSVPDT

SEQ ID NO: 5874 - protein, 127 aa, Artificial Sequence; identical to SEQ ID NO: 5730
  Synthetic

SEQ ID NO: 5875 - protein, 20 aa, Artificial Sequence
  Synthetic
ARDRWLADVVVPAAIYPLGY

SEQ ID NO: 5876 - protein, 107 aa, Artificial Sequence; identical to SEQ ID NO: 5732
  Synthetic

SEQ ID NO: 5877 - protein, 9 aa, Artificial Sequence
  Synthetic
QQYNSSPGT

SEQ ID NO: 5878 - protein, 126 aa, Artificial Sequence
  Synthetic
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDQRIMSSSIYYYYGMDVWGQGTTVTVSS

SEQ ID NO: 5879 - protein, 19 aa, Artificial Sequence
  Synthetic
ARDQRIMSSSIYYYYGMDV

SEQ ID NO: 5880 - protein, 112 aa, Artificial Sequence
  Synthetic
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPYTFGQGTKLEIK

SEQ ID NO: 5881 - protein, 9 aa, Artificial Sequence
  Synthetic
MQGTHWPYT

SEQ ID NO: 5882 - protein, 125 aa, Artificial Sequence
  Synthetic
QVQLVQSGAEVKKPGSSVKVSCKASGGTFSSFIISWVRQAPGQGLEWMGRIIPIVGKANYAQKFQGRVTITADKSASTAYMELSSLRSEDTAVYYCAREDIEEVPAAFAYAFDIWGQGTMVTVSS

SEQ ID NO: 5883 - protein, 18 aa, Artificial Sequence
  Synthetic
AREDIEEVPAAFAYAFDI

SEQ ID NO: 5884 - protein, 110 aa, Artificial Sequence
  Synthetic
EIVLTQSPGTLSLSPGERATLSCRASQSLSSSYLAWYQQKPGQAPRLLIYGASSRATGIPDRFSGSGSGTDFTLTISRLEPEDFAVYYCQQFVTSPPSWTFGQGTKVEIK

SEQ ID NO: 5885 - protein, 11 aa, Artificial Sequence
  Synthetic
QQFVTSPPSWT

SEQ ID NO: 5886 - protein, 126 aa, Artificial Sequence
  Synthetic
EVQLVESGGGLEQPGGSLRLSCAASGFSFSSYDMHWVRQVTGKGLEWVSAIGTSGDTYYSGSVKGRFTISRENAKNSLYLQMNNLRAGDTAVYYCARGTTVTTGPIRSYYYYMDVWGKGTTVTVSS

SEQ ID NO: 5887 - protein, 20 aa, Artificial Sequence
  Synthetic
ARGTTVTTGPIRSYYYYMDV

SEQ ID NO: 5888 - protein, 108 aa, Artificial Sequence
  Synthetic
DIQMTQSPSSLSASVGDRVTITCRASQSISRYLNWYQQKPGKAPKVLIYAASSLQSGVPSRFSGSGSGTDFTLTISSLQVEDFATYYCQQSYSSPPWTFGQGTKVEIK

SEQ ID NO: 5889 - protein, 10 aa, Artificial Sequence
  Synthetic
QQSYSSPPWT

SEQ ID NO: 5890 - protein, 121 aa, Artificial Sequence
  Synthetic
QVQLVQSGAEVKKPGSSVKVSCKASGGTFSSDAISWVRQAPGQGLEWMGGIIPIFGTANYAQKFRDRVTITADESTSTAYMELRSLRTEDTAVYYCAKDVRESPLYGMDVWGQGTTVTVSS

SEQ ID NO: 5891 - protein, 14 aa, Artificial Sequence
  Synthetic
AKDVRESPLYGMDV

SEQ ID NO: 5892 - protein, 107 aa, Artificial Sequence
  Synthetic
DIQMTQSPSSLSASVGDRVTITCRASQSIRSFLNWYQQKPGKAPTLLIYAASSLHSGVPSRFSGSGSGTDFTLTISSLQPEDFATYFCQQSYSSPLTFGGGTKVDIK

SEQ ID NO: 5893 - protein, 9 aa, Artificial Sequence
  Synthetic
QQSYSSPLT

SEQ ID NO: 5894 - protein, 121 aa, Artificial Sequence
  Synthetic
QVQLVQSGAEVKKPGSSVKVSCTASGGTFSSDAINWVRQAPGQGLEWMGRIIPIFGSANYAQKFQDRVTITADESTSTAYMALSSLRSEDTAVYYCAKDVTTSPLYGMDVWGQGTTVTVSS

SEQ ID NO: 5895 - protein, 14 aa, Artificial Sequence
  Synthetic
AKDVTTSPLYGMDV

SEQ ID NO: 5896 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTEFTLTISSLQPEDFATYYCQQSYITPLVTFGGGTKVEIK

SEQ ID NO: 5897 - protein, 10 aa, Artificial Sequence
  Synthetic
QQSYITPLVT

SEQ ID NO: 5898 - protein, 125 aa, Artificial Sequence
  Synthetic
EVQLVESGGGLVQPGGSLRLSCAASGFTFSRDDMHWVRQATGKGLEWVAVIGTAGDTYYLGSVKGRFTISRENAKSSLYLQMNSLRAGDTAVYYCARGVAVRPTAAKYYYYMDVWGKGTTVTVSS

SEQ ID NO: 5899 - protein, 19 aa, Artificial Sequence
  Synthetic
ARGVAVRPTAAKYYYYMDV

SEQ ID NO: 5900 - protein, 108 aa, Artificial Sequence
  Synthetic
DIQMTQSPSSLSASVGDRVTITCRASQSISNYLNWYQQKPGKAPKLLIYAASSLQSGVPSRFSGSGSGTDFTLTISSLQPEDFAAYFCQQSYSMPPWTFGPGTKVEFK

SEQ ID NO: 5901 - protein, 10 aa, Artificial Sequence
  Synthetic
QQSYSMPPWT

SEQ ID NO: 5902 - protein, 123 aa, Artificial Sequence
  Synthetic
EVQLVESGGGLVQPGRSLRLSCAASGFTFDDYAMHWVRQAPGKGLEWVSGISWNSGSIVYADSVKGRFTVSRDDARNSLYLQMNSLRAEDTALYYCAKVSRRSVLLHDAFDIWGQGTMVTVSS

SEQ ID NO: 5903 - protein, 16 aa, Artificial Sequence
  Synthetic
AKVSRRSVLLHDAFDI

SEQ ID NO: 5904 - protein, 109 aa, Artificial Sequence
  Synthetic
EIVMTQSPATLSVSPGERATLSCRASQSINNNLAWYQQKPGQAPRLLIYGASTRATGIPARFSGSESGTEFTLTISSLQSEDFAVYYCQQYNNWPPGLTFGGGTKVEIK

SEQ ID NO: 5905 - protein, 11 aa, Artificial Sequence
  Synthetic
QQYNNWPPGLT

SEQ ID NO: 5906 - protein, 117 aa, Artificial Sequence
  Synthetic
EVQLVESGGGLIQPGGSLRLSCAASGITVSSNYMNWVRQAPGKGLEWVSIIYSGGTTYYADSVKGRFTISRDNSKNTLYLQMNSLRAEDTAVYYCARDLQVYGMDVWGQGTTVTVSS

SEQ ID NO: 5907 - protein, 11 aa, Artificial Sequence
  Synthetic
ARDLQVYGMDV

SEQ ID NO: 5908 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQAEDFATYYCQHPNSYSISFGQGTRLEIK

SEQ ID NO: 5909 - protein, 9 aa, Artificial Sequence
  Synthetic
QHPNSYSIS

SEQ ID NO: 5910 - protein, 117 aa, Artificial Sequence
  Synthetic
EVQLVESGGGLIQPGGSLRLSCAASGITVSSNYMNWVRQAPGKGLQWVSVIYSGGSTFYADSVKGRFTISRDSSKNTLYLQMNSLRPEDTAVYYCARDLQVYGMDVWGQGTTVTVSS

SEQ ID NO: 5911 - protein, 11 aa, Artificial Sequence
  Synthetic
ARDLQVYGMDV

SEQ ID NO: 5912 - protein, 107 aa, Artificial Sequence
  Synthetic
DIQLTQSPSFLSASVGDRVTITCRASQGISSYLAWYQQKPGKAPKLLIYAASTLQSGVPSRFSGSGSGTEFTLTISSLQPEDFATYYCQQPNTYSISFGQGTRLEIK

SEQ ID NO: 5913 - protein, 9 aa, Artificial Sequence
  Synthetic
QQPNTYSIS

SEQ ID NO: 5914 - protein, 121 aa, Artificial Sequence
  Synthetic
QVQLVQSGAEVKKPGSSVKVSCKASGGTFSSDAISWVRQAPGQGLEWMGGIIPIFGTTNYAQNFQARVTITADESTNTAYMELRSLRSEDTAVYYCAKDVTTSPLYGMDVWGQGTMVTVSS

SEQ ID NO: 5915 - protein, 14 aa, Artificial Sequence
  Synthetic
AKDVTTSPLYGMDV

SEQ ID NO: 5916 - protein, 108 aa, Artificial Sequence
  Synthetic
DIQMTQSPSSLSASVGDRVTITCRASQSISRYLNWYQQKPGKAPKLLIYAASSLQSGVPSRFSGSGSGTDFTLTISSLQPEDFATYYCQQSYRTPLVTFGGGTKVEIK

SEQ ID NO: 5917 - protein, 10 aa, Artificial Sequence
  Synthetic
QQSYRTPLVT

SEQ ID NO: 5918 - protein, 123 aa, Artificial Sequence
  Synthetic
QMQLVQSGPEVKKPGTSVKVSCKASGFTFSSSAVQWVRQARGQRLEWIGWIVVGSGNTDYAQKFQERVTMTRDMSTSTAYMELSSLRSDDTAVYYCAAPDCNRTTCRDGFDIWGQGTRVTVSS

SEQ ID NO: 5919 - protein, 16 aa, Artificial Sequence
  Synthetic
AAPDCNRTTCRDGFDI

SEQ ID NO: 5920 - protein, 108 aa, Artificial Sequence
  Synthetic
EIVLTQSPGTLSLSPGERATLSCRASQSVSRSYLAWYQQKPGQAPRLLIYGATSRATGIPDRFSGSGSGTDFTLTISRLEPEDFAVYYCQQYGSSPWTFGQGTKVEIK

SEQ ID NO: 5921 - protein, 9 aa, Artificial Sequence
  Synthetic
QQYGSSPWT

SEQ ID NO: 5922 - protein, 125 aa, Artificial Sequence
  Synthetic
QVQLVQSGAEVKKPGASVKVSCKASGYTFTSYGISWVRQAPGQGLEWMGWISAYNGNTNYAQNLQGRVTMTTDKSTSTAYMELRSLRSDDTAIYYCARVESFYYGSGSLYYFDYWGQGTLVTVSS

SEQ ID NO: 5923 - protein, 18 aa, Artificial Sequence
  Synthetic
ARVESFYYGSGSLYYFDY

SEQ ID NO: 5924 - protein, 109 aa, Artificial Sequence
  Synthetic
EIVMTQSPATLSVSPGESATLSCRASQSISSILAWYQQKPGQAPRLLIYGASTRATGIPARFSGSGSGTEFTLTISSLQSEDFAVYYCQHYDNWPPTWTFGQGTKVEIK

SEQ ID NO: 5925 - protein, 11 aa, Artificial Sequence
  Synthetic
QHYDNWPPTWT

SEQ ID NO: 5926 - protein, 117 aa, Artificial Sequence
  Synthetic
EVQLVESGGGLVQPGRSLRLSCAASGFTLSNYDMHWVRQVTGKGLEWVSGIDTAGESYYVGSVKGRFTVSRENAKNSFYLQMNSLRAGDTAVYYCTRTRPGQEFDYWGQGTLVTVSS

SEQ ID NO: 5927 - protein, 11 aa, Artificial Sequence
  Synthetic
TRTRPGQEFDY

SEQ ID NO: 5928 - protein, 106 aa, Artificial Sequence
  Synthetic
DIQMTQSPSTLSASVGDRVTITCRASQSISPWLAWYQQKPGKAPKLLIYRTFSLESGVPSRFSGSGSGTEFTLTISGLQPDDFATYYCQQYNNYWTFGQGTKVEIK

SEQ ID NO: 5929 - protein, 8 aa, Artificial Sequence
  Synthetic
QQYNNYWT

SEQ ID NO: 5930 - protein, 127 aa, Artificial Sequence
  Synthetic
QVQLVESGGGVVQPGRSLRLSCAASGFTFSNYAMHWVRQAPGKGLEWVAVISYDGSNKYYTDSVKGRFTISRDTSKNTLYLQMNSLRAEDTAVYFCARQLYYYDRSGFLHGDAFDIWGQGTMVTVSS

SEQ ID NO: 5931 - protein, 20 aa, Artificial Sequence
  Synthetic
ARQLYYYDRSGFLHGDAFDI

SEQ ID NO: 5932 - protein, 108 aa, Artificial Sequence
  Synthetic
DIQMTQSPSSLSASVGDRVTITCRASQGISNYLAWYQQKPGKVPKLLIYAASTLQSGVPSRFSGSGSGTDFTLTISSLQPEDVATYYCQKYNSAPTWTFGQGTKVEIK

SEQ ID NO: 5933 - protein, 10 aa, Artificial Sequence
  Synthetic
QKYNSAPTWT

SEQ ID NO: 5934 - protein, 122 aa, Artificial Sequence
  Synthetic
EVQLVESGGGLIQPGGSLRLSCAVSGFTVSTNFMSWVRQAPGKGLEWVSVIYSGGNSYYADSVKGRFTVSRDNSKNTLYLQMNSLRADDTAVYYCARDLRHGDPPLYNSEYWGQGTLATVSS

SEQ ID NO: 5935 - protein, 16 aa, Artificial Sequence
  Synthetic
ARDLRHGDPPLYNSEY

SEQ ID NO: 5936 - protein, 107 aa, Artificial Sequence
  Synthetic
DIQMTQSPSTLSASVGDRVTITCRASQSISSWLAWYQQKPGKAPKVLIFKASSLENGVPSRFSGSGSGTEFTLTISSLQPDDFATYYCQQYNSYPWTFGQGTKVEIK

SEQ ID NO: 5937 - protein, 9 aa, Artificial Sequence
  Synthetic
QQYNSYPWT

SEQ ID NO: 5938 - protein, 121 aa, Artificial Sequence
  Synthetic
QVQLVQSGAEVKKPGSSVKVSCKASGGTFSSDAINWVRQAPGQGLEWMGGIIPIFGTTNYAQKFQGRVTITADESTSTAYMELSSLRSEDTAVYYCARDVTTSPLYGMDVWGQGTMVTVSS

SEQ ID NO: 5939 - protein, 14 aa, Artificial Sequence
  Synthetic
ARDVTTSPLYGMDV

SEQ ID NO: 5940 - protein, 108 aa, Artificial Sequence
  Synthetic
DIQMTQSPSSLSASVGDRVTITCRASQSISRYLNWYQQKPGKAPKLLIYAASSLQSGVPSRFSGSGSGTDFTLTISSLQPEDFATYYCQQSYRTPLVTFGGGTKVEMK

SEQ ID NO: 5941 - protein, 10 aa, Artificial Sequence
  Synthetic
QQSYRTPLVT

SEQ ID NO: 5942 - protein, 125 aa, Artificial Sequence
  Synthetic
EVQLVESGGGLVQPGGSLRLSCAASGFTFSTYWMSWVRQAPGKGLEWVANIKQDGSERYYVDSVKGRFTISRDNTKNSLYLQMNSLSAEDTAVYYCARDLGLLWFGDDPLARDVWDKGTTVTVSS

SEQ ID NO: 5943 - protein, 18 aa, Artificial Sequence
  Synthetic
ARDLGLLWFGDDPLARDV

SEQ ID NO: 5944 - protein, 107 aa, Artificial Sequence
  Synthetic
DIQMTQSPSSLSASVGDRVTITCRASQGISNSLAWYQQTPGKAPKLLLYAASTLESGVPSRFSGSGSGTDYTLTISSLQPQDFATYYCLQYYSTPRTFGQGTKLEIK

SEQ ID NO: 5945 - protein, 9 aa, Artificial Sequence
  Synthetic
LQYYSTPRT

SEQ ID NO: 5946 - protein, 128 aa, Artificial Sequence
  Synthetic
EVQLVESGGGLVQPGGSLRLSCAASGFTFSSYDMHWVRQVAGKGLEWVSAMGTAGDTYYADSVKGRFTISRENAKNSLYLQLNSLRAGDTAVYYCARGDTSMISETSQNYYYYYMDVWGKGTTVTVSS

SEQ ID NO: 5947 - protein, 22 aa, Artificial Sequence
  Synthetic
ARGDTSMISETSQNYYYYYMDV

SEQ ID NO: 5948 - protein, 108 aa, Artificial Sequence
  Synthetic
DIQMTQSPSSLSASVGDRVTITCRASQSIRRYLNWYQQKPGKAPKLLIYAASSLQSGVPSRFSGSGSGTDFTLTISSLQPEDFATYYCQQSYSSPPWTFGQGTKVEIK

SEQ ID NO: 5949 - protein, 10 aa, Artificial Sequence
  Synthetic
QQSYSSPPWT

SEQ ID NO: 5950 - protein, 122 aa, Artificial Sequence
  Synthetic
QVQLVQSGAEVKKPGASVKVSCKASGYTFTNYYMHWVRQAPGQGLEWMGIINPSGDSTSYAQKFQGRVTMTSDTSTSTVYMELSSLRSEDTAVYYCARDQWLIPASSAFDIWGQGAMVTVSS

SEQ ID NO: 5951 - protein, 15 aa, Artificial Sequence
  Synthetic
ARDQWLIPASSAFDI

SEQ ID NO: 5952 - protein, 107 aa, Artificial Sequence
  Synthetic
EIVLTQSPGTLSLSPGERATLSCRASQSVSSSYLAWYQQKPGQAPRLLIFGASSRATGIPDRFSGSGSGTDFTLTISRLEPEDFAVYYCQQFGSSPTFGGGTKVEIK

SEQ ID NO: 5953 - protein, 8 aa, Artificial Sequence
  Synthetic
QQFGSSPT

SEQ ID NO: 5954 - protein, 117 aa, Artificial Sequence
  Synthetic
QLQLQESGPGLVKPSETLSLTCTVSGGSISSTNNYWGWIRQSPGTGLEWIGSIYYSGSTYYNPSLKSRVTISVDTSKNQFSLRLSSVTAADTAVYYCARLLGAVFGWGQGTLVTVSS

SEQ ID NO: 5955 - protein, 9 aa, Artificial Sequence
  Synthetic
ARLLGAVFG

SEQ ID NO: 5956 - protein, 108 aa, Artificial Sequence
  Synthetic
DIQMTQSPSSLSASVGDRVTITCRASQGISNSLAWYQQIPGKAPKLLLYAASTLESGVPSRFSGTASGTVYTLIISSLQPEDFATYYCQQYYSTPPLTFGGGTKVEVK

SEQ ID NO: 5957 - protein, 10 aa, Artificial Sequence
  Synthetic
QQYYSTPPLT

SEQ ID NO: 5958 - protein, 127 aa, Artificial Sequence
  Synthetic
QVQLVESGGGVVQPGRSLRLSCAASGFTFSHYGIHWVRQAPGKGLEWVAVISFDGTHKYYADSVKGRFTISRDNSKNTLYLQMNSLRAEDTAVYYCAKQGGPYCSGGVCYTGYFDYWGQGTLVTVSS

SEQ ID NO: 5959 - protein, 20 aa, Artificial Sequence
  Synthetic
AKQGGPYCSGGVCYTGYFDY

SEQ ID NO: 5960 - protein, 106 aa, Artificial Sequence
  Synthetic
DIQMTQSPSSLSASVGDRVTITCQASHDITNYLNWYQQKPGKAPKLLIYDVSNLETGVPSRFSGSGSGTDFTFTISSLQPEDIATYYCQQYDNLPTFGPGTKVDIK

SEQ ID NO: 5961 - protein, 8 aa, Artificial Sequence
  Synthetic
QQYDNLPT

SEQ ID NO: 5962 - protein, 121 aa, Artificial Sequence
  Synthetic
EVQLVESGGGLVQPGGSLRLSCAASGFTVSSNYMSWVRQAPGKGLEWVSVIYSDIIYSGGNTYYADSVKGRFTISRHNSKNTLYLQMTSLRAEDTAVYYCARLVSDAFDLWGQGTMVTVSS

SEQ ID NO: 5963 - protein, 10 aa, Artificial Sequence
  Synthetic
ARLVSDAFDL

SEQ ID NO: 5964 - protein, 107 aa, Artificial Sequence
  Synthetic
DIQMTQSPSTLSASVGDRVTITCRASQSVSSWLAWYQQKPGKAPKLLIYKASSLESGVPSRFSGSGSGTEFTLTISSLQPDDFATYYCQQYNSDSYTFGQGTKLEIK

SEQ ID NO: 5965 - protein, 9 aa, Artificial Sequence
  Synthetic
QQYNSDSYT

SEQ ID NO: 5966 - protein, 122 aa, Artificial Sequence
  Synthetic
QVQLVQSGAEVKKPGASVKVSCKASGYSITTYYMHWVRQAPGQGLEWMGIINPSAGSTSYAQKFQGRVTMTRDTATSTVYMDLSSLRSEDTAVYYCARGGLIPDSTNWFDPWGQGTLVTVSS

SEQ ID NO: 5967 - protein, 15 aa, Artificial Sequence
  Synthetic
ARGGLIPDSTNWFDP

SEQ ID NO: 5968 - protein, 106 aa, Artificial Sequence
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNSFTFGPGTKVDIK

SEQ ID NO: 5969 - protein, 8 aa, Artificial Sequence
  Synthetic
QQRSNSFT

SEQ ID NO: 5970 - protein, 124 aa, Artificial Sequence
  Synthetic
QVQLQESGPGLVKPSETLSLTCTVSGGAISSYYWSWIRQPPGRGLEWIGYIDHSGSTNYSPSLKSRVTLSVDTSQNQFSLNLSSVTAADTAVYYCARAEIMPLEYGSGTYYPLWGQGTLVTVSS

SEQ ID NO: 5971 - protein, 18 aa, Artificial Sequence
  Synthetic
ARAEIMPLEYGSGTYYPL

SEQ ID NO: 5972 - protein, 108 aa, Artificial Sequence
  Synthetic
DIQMTQSPSTLSASVGDRVTITCRASQSISKWLAWYQQKPGKAPKLLIYKTSSLESGVPSRFSGSGSGTEFTLTISSLQPDDFATYYCQQYNNYSPLTFGGGTKVEIK

SEQ ID NO: 5973 - protein, 10 aa, Artificial Sequence
  Synthetic
QQYNNYSPLT

SEQ ID NO: 5974 - protein, 123 aa, Artificial Sequence
  Synthetic
EVQLVESGGGLIQPGGSLRLSCAASGFTVSSNYMSWVRQAPGKGLEWVSVIYSGGSTNYADSVKGRFTVSRDNSKNTLYLQMNSLRAEDTAVYYCARDRRIGIPFYYYYMDVWGQGTTVTVSS

SEQ ID NO: 5975 - protein, 17 aa, Artificial Sequence
  Synthetic
ARDRRIGIPFYYYYMDV

SEQ ID NO: 5976 - protein, 109 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPGLTFGGGTKVEIK

SEQ ID NO: 5977 - protein, 10 aa, Artificial Sequence
  Synthetic
QQYGSSPGLT

SEQ ID NO: 5978 - protein, 131 aa, Artificial Sequence
  Synthetic
QVQLVESGGGVVQPGRSLRLSCTVSGFTFRKYAMHWVRQAPGKGLEWVAVISYDGTNDGTNKYYADSVKGRFTISRDNSKNTLYLQMNSLRAEDTAVYYCAKGGGEYCSGGNCYQSYFDYWGQGTLVTVSS

SEQ ID NO: 5979 - protein, 20 aa, Artificial Sequence
  Synthetic
AKGGGEYCSGGNCYQSYFDY

SEQ ID NO: 5980 - protein, 107 aa, Artificial Sequence
  Synthetic
DIQMTQSPSSLSASVGDRVTITCQASQDISKYLNWYQQKPGKAPKLLIYDASNLETGVPSRFSGSGSGTDFTFTISSLQPEDFAAYYCQQYDNLPLTFGGGTKVEIK

SEQ ID NO: 5981 - protein, 9 aa, Artificial Sequence
  Synthetic
QQYDNLPLT

SEQ ID NO: 5982 - protein, 126 aa, Artificial Sequence
  Synthetic
QVQLVESGGGVVQPGRSLRLSCAASGFTFSNFGMHWVRQAPGKGLEWVAVIWYDGSNKHYADSVKGRFTISRDNSKSTLYLQMNSLRAEDTAVYYCARDPDYGDLRGDLYYGMDVWGQGTTVTVSS

SEQ ID NO: 5983 - protein, 19 aa, Artificial Sequence
  Synthetic
ARDPDYGDLRGDLYYGMDV

SEQ ID NO: 5984 - protein, 107 aa, Artificial Sequence
  Synthetic
DIQLTQSPSFLSASVGDRVTITCRASQGISSYLAWYQQKPGKAPKLLISAASTLQSGVPSRFSGSGSGTDFTLTISGLQPEDFATYYCQQLNSYPFTFGPGTKVDIK

SEQ ID NO: 5985 - protein, 9 aa, Artificial Sequence
  Synthetic
QQLNSYPFT

SEQ ID NO: 5986 - protein, 121 aa, Artificial Sequence
  Synthetic
QVQLVQSGAEVKKPGSSVKVSCKASGGTFSSDAISWVRQAPGQGLEWMGGIIPIFGTTNYAQKFQGRVTITADESTSTAYMELSSLRFEDTAVYYCARDVTTSPLYGMDVWGQGTMVTVSS

SEQ ID NO: 5987 - protein, 14 aa, Artificial Sequence
  Synthetic
ARDVTTSPLYGMDV

SEQ ID NO: 5988 - protein, 107 aa, Artificial Sequence
  Synthetic
DIQMTQSPSSLSASVGDRVTITCRASQSISRYLNWYQQKPGKAPKLLIYAASSLQSGVPSRFSGSGSGTDFTLTISSLQPDFATYYCQQSYRTPLLTFGGGTKVEIK

SEQ ID NO: 5989 - protein, 10 aa, Artificial Sequence
  Synthetic
QQSYRTPLLT

SEQ ID NO: 5990 - protein, 121 aa, Artificial Sequence
  Synthetic
QVQLVQSGAEVKKPGSSVKVSCKASGGTFSSNAIRWVRQAPGHGLEWMGGIIPIFGTTNYAQKFQGRVTITADESTSTAYMELSSLRSEDTAVYYCARDQTESPLYGMDVWGQGTTVTVSS

SEQ ID NO: 5991 - protein, 14 aa, Artificial Sequence
  Synthetic
ARDQTESPLYGMDV

SEQ ID NO: 5992 - protein, 107 aa, Artificial Sequence
  Synthetic
DIQMTQSPSSLSASVGDRVTISCRASQSIIRYLNWYQQKPGTAPKLLIYAASSLQSGVPSRFSGSGSGTDFTLTISSLQPEDFATYYCQQSYSTLLTFGGGTKVEIK

SEQ ID NO: 5993 - protein, 9 aa, Artificial Sequence
  Synthetic
QQSYSTLLT

What is claimed is:

1. An isolated anti-SARS-CoV-2 antibody or antigen-binding fragment thereof that binds specifically to a SARS-CoV-2 antigen, comprising three heavy chain complementarity determining regions (HCDRs) (HCDR1, HCDR2, and HCDR3) of a heavy chain variable region having the amino acid sequence of SEQ ID NO: 1 and three light chain CDRs (LCDR1, LCDR2, and LCDR3) of a light chain variable region having the amino acid sequence of SEQ ID NO: 2.

2. The antibody or antigen-binding fragment thereof of claim 1, wherein the SARS-CoV-2 antigen comprises a Spike (S) polypeptide.

3. The antibody or antigen-binding fragment thereof of claim 1, wherein the antibody or antigen-binding fragment thereof is capable of neutralizing a plurality of SARS-CoV-2 strains.

4. The antibody or antigen-binding fragment thereof of claim 1, wherein the anti-SARS-CoV-2 antibody or antigen-binding fragment thereof comprises a heavy chain variable region of SEQ ID NO: 1 and a light chain variable region of SEQ ID NO: 2.

5. The antibody or antigen-binding fragment thereof of claim 1, wherein the antibody or antigen-binding fragment thereof is a multivalent antibody comprising (a) a first target binding site comprising three heavy chain complementarity determining regions (HCDRs) (HCDR1, HCDR2, and HCDR3) of a heavy chain variable region having the amino acid sequence of SEQ ID NO: 1 and three light chain CDRs (LCDR1, LCDR2, and LCDR3) of a light chain variable region having the amino acid sequence of SEQ ID NO: 2 that specifically binds to an epitope within the S polypeptide, and (b) a second target binding site that binds to an epitope on a different epitope on the S polypeptide or a different molecule.

6. The antibody or antigen-binding fragment thereof of claim 5, wherein the multivalent antibody is a bivalent or bispecific antibody.

7. The antibody or the antigen-binding fragment thereof of claim 1, further comprising an Fc region or a variant Fc region.

8. The antibody or antigen-binding fragment thereof of claim 1, wherein the antibody is a monoclonal antibody.

9. The antibody or antigen-binding fragment thereof of claim 1, wherein the antibody is a chimeric antibody, a humanized antibody, or humanized monoclonal antibody.

10. The antibody or antigen-binding fragment thereof of claim 1, wherein the antibody is a single-chain antibody, a Fab fragment, or a Fab2 fragment.

11. A pharmaceutical composition comprising the antibody or antigen-binding fragment thereof of claim 1 and optionally a pharmaceutically acceptable carrier or excipient.

12. The pharmaceutical composition of claim 11, further comprising a second therapeutic agent.

13. The pharmaceutical composition of claim 12, wherein the second therapeutic agent comprises an anti-inflammatory drug or an antiviral compound.

14. A kit comprising the pharmaceutical composition of claim 11 for the diagnosis, prophylaxis, treatment, or combination thereof of a condition resulting from a SARS-CoV-2 infection.

15. A nucleic acid molecule encoding a polypeptide chain of the antibody or antigen-binding fragment thereof of claim 1.

16. A vector comprising the nucleic acid molecule of claim 15.

17. A cultured host cell comprising the nucleic acid molecule of claim 15.

18. A method of preparing an antibody, or antigen-binding portion thereof, comprising:
    obtaining the cultured host cell of claim 17;
    culturing the cultured host cell in a medium under conditions permitting expression of a polypeptide encoded by the nucleic acid molecule and assembling of an antibody or fragment thereof; and
    purifying the antibody or fragment from the cultured cell or the medium of the cell.

19. A kit comprising a pharmaceutically acceptable dose unit of the antibody or antigen-binding fragment thereof of claim 1.

20. A kit for the diagnosis, prognosis or monitoring the treatment of SARS-CoV-2 infection in a subject, comprising: the antibody or antigen-binding fragment thereof of claim 1; and at least one detection reagent that binds specifically to the antibody or antigen-binding fragment thereof.

21. A method of neutralizing SARS-CoV-2 in a subject, comprising administering to a subject in need thereof a therapeutically effective amount of the antibody or antigen-binding fragment thereof of claim 1.

22. A method of treating a SARS-CoV-2 infection, comprising administering to a subject in need thereof a therapeutically effective amount of the antibody or antigen-binding fragment thereof of claim 1.

23. The method of claim 22, further comprising administering to the subject a therapeutically effective amount of a second therapeutic agent or therapy.

24. The method of claim 23, wherein the second therapeutic agent comprises an anti-inflammatory drug or an antiviral compound.

25. The method of claim 21, wherein the antibody or antigen-binding fragment thereof is administered to the subject intravenously, subcutaneously, or intraperitoneally.

26. The method of claim 21, wherein the antibody or antigen-binding fragment thereof is administered prophylactically or therapeutically.

27. A method for detecting the presence of SARS COV-2 in a sample comprising:
- contacting a sample with the antibody or antigen-binding fragment thereof of claim 1; and
- determining binding of the antibody or antigen-binding fragment to one or more SARS CoV-2 antigens,
- wherein binding of the antibody to the one or more SARS CoV-2 antigens is indicative of the presence of SARS CoV-2 in the sample.

* * * * *